US012630841B2

(12) United States Patent
Reid

(10) Patent No.: US 12,630,841 B2
(45) Date of Patent: May 19, 2026

---

(54) ADENO-ASSOCIATED VIRUS WITH ENGINEERED CAPSID

(71) Applicant: Tenaya Therapeutics, Inc., South San Francisco, CA (US)

(72) Inventor: Christopher A. Reid, South San Francisco, CA (US)

(73) Assignee: Tenaya Therapeutics, Inc., South San Francisco, CA (US)

( * ) Notice: Subject to any disclaimer, the term of this patent is extended or adjusted under 35 U.S.C. 154(b) by 1179 days.

(21) Appl. No.: 17/599,750

(22) PCT Filed: Mar. 31, 2020

(86) PCT No.: PCT/US2020/026009
§ 371 (c)(1),
(2) Date: Sep. 29, 2021

(87) PCT Pub. No.: WO2020/205889
PCT Pub. Date: Oct. 8, 2020

(65) Prior Publication Data
US 2022/0154217 A1     May 19, 2022

Related U.S. Application Data

(60) Provisional application No. 62/984,197, filed on Mar. 2, 2020, provisional application No. 62/827,576, filed on Apr. 1, 2019.

(51) Int. Cl.
| | |
|---|---|
| *A61K 48/00* | (2006.01) |
| *A61P 9/00* | (2006.01) |
| *C07K 14/005* | (2006.01) |
| *C12N 7/00* | (2006.01) |
| *C12N 15/10* | (2006.01) |
| *C12N 15/86* | (2006.01) |

(52) U.S. Cl.
CPC ............... *C12N 15/86* (2013.01); *A61P 9/00* (2018.01); *C12N 7/00* (2013.01); *C12N 15/1055* (2013.01); *C12N 2750/14121* (2013.01); *C12N 2750/14143* (2013.01); *C12N 2750/14145* (2013.01); *C12N 2750/14171* (2013.01)

(58) Field of Classification Search
None
See application file for complete search history.

(56) References Cited

U.S. PATENT DOCUMENTS

| | | |
|---|---|---|
| 4,683,195 A | 7/1987 | Mullis et al. |
| 4,683,202 A | 7/1987 | Mullis |
| 4,797,368 A | 1/1989 | Carter et al. |
| 4,962,091 A | 10/1990 | Eppstein et al. |
| 5,139,941 A | 8/1992 | Muzyczka et al. |
| 5,449,614 A | 9/1995 | Danos et al. |
| 5,591,624 A | 1/1997 | Barber et al. |

| | | |
|---|---|---|
| 5,817,491 A | 10/1998 | Yee et al. |
| 5,834,256 A | 11/1998 | Finer et al. |
| 5,925,565 A | 7/1999 | Berlioz et al. |
| 5,928,906 A | 7/1999 | Koster et al. |
| 5,935,819 A | 8/1999 | Eichner et al. |
| 5,994,136 A | 11/1999 | Naldini et al. |
| 6,013,516 A | 1/2000 | Verma et al. |
| 6,156,303 A | 12/2000 | Russell et al. |
| 6,306,434 B1 | 10/2001 | Hong, II et al. |
| 6,872,528 B2 | 3/2005 | Klatzmann et al. |
| 6,910,434 B2 | 6/2005 | Lundgren |
| 6,962,815 B2 | 11/2005 | Bartlett |
| 6,984,517 B1 | 1/2006 | Chiorini et al. |
| 6,995,009 B1 | 2/2006 | Kitamura et al. |
| 7,070,994 B2 | 7/2006 | Barber et al. |
| 7,091,029 B2 | 8/2006 | Hwang |
| 7,105,345 B2 | 9/2006 | Wilson et al. |
| 7,198,951 B2 | 4/2007 | Gao et al. |
| 7,259,151 B2 | 8/2007 | Arbetman et al. |
| 7,718,424 B2 | 5/2010 | Chiorini et al. |
| 7,790,449 B2 | 9/2010 | Gao et al. |
| 7,867,484 B2 | 1/2011 | Samulski et al. |
| 7,906,111 B2 | 3/2011 | Wilson et al. |
| 8,119,119 B2 | 2/2012 | Mallet et al. |
| 8,524,446 B2 | 9/2013 | Gao et al. |
| 8,679,837 B2 | 3/2014 | Zolotukhin et al. |
| 8,784,799 B2 | 7/2014 | Samulski et al. |
| 8,906,675 B2 | 12/2014 | Gao et al. |

(Continued)

FOREIGN PATENT DOCUMENTS

| | | |
|---|---|---|
| CA | 3031026 A1 | 2/2018 |
| CN | 109476707 A | 3/2019 |

(Continued)

OTHER PUBLICATIONS

Bantel-Schaal et al. "Human Adeno-Associated Virus Type 5 Is Only Distantly Related to Other Known Primate Helper-Dependent Parvoviruses." Journal of Virology, vol. 73, No. 2, pp. 939-947 (Feb. 1999).

Chiorini et al. "Cloning and Characterization of Adeno-Associated Virus Type 5." Journal of Virology, vol. 73, No. 2, pp. 1309-1319 (Feb. 1999).

Chiorini et al. "Cloning of Adeno-Associated Virus Type 4 (AAV4) and Generation of Recombinant AAV4 Particles," Journal of Virology, vol. 71, No. 9, pp. 6823-6833 (Sep. 1997).

Gao et al., "A novel and efficient model of coronary artery ligation and myocardial infarction in the mouse," Circulation Research, 107: 1445-1453 (Dec. 2010), DOI: 10.1161/CIRCRESAHA.110.223925.

Gao et al. "Novel adeno-associated viruses from rhesus monkeys as vectors for human gene therapy" PNAS, vol. 99, No. 18, pp. 11854-11859 (Sep. 2002).

(Continued)

*Primary Examiner* — Maria Marvich
(74) *Attorney, Agent, or Firm* — Goodwin Procter LLP

(57)     ABSTRACT

The present disclosure provides recombinant adeno-associated virus (rAAV) virions with an engineered capsid protein identified using a high-throughput sequencing screen or rational design. In particular, the disclosure provides AAV5 virions and capsid proteins with increased transduction efficiency in cardiac cells, increased cell-type selectivity, and/or other desirable properties.

10 Claims, 16 Drawing Sheets
Specification includes a Sequence Listing.

(56) References Cited

U.S. PATENT DOCUMENTS

| | | |
|---|---|---|
| 8,999,678 B2 | 4/2015 | Vandenberghe et al. |
| 9,169,494 B2 | 10/2015 | Hewitt et al. |
| 9,233,131 B2 | 1/2016 | Schaffer et al. |
| 9,434,928 B2 | 9/2016 | Mendell et al. |
| 9,441,206 B2 | 9/2016 | Grieger et al. |
| 9,441,244 B2 | 9/2016 | Schaffer et al. |
| 9,447,433 B2 | 9/2016 | Hirsch et al. |
| 9,737,618 B2 | 8/2017 | Wilson et al. |
| 9,783,824 B2 | 10/2017 | Kay et al. |
| 9,790,472 B2 | 10/2017 | Gao et al. |
| 10,036,016 B2 | 7/2018 | Cohen et al. |
| 10,046,016 B2 | 8/2018 | Schaffer et al. |
| 10,214,566 B2 | 2/2019 | Schaffer et al. |
| 10,485,883 B2 | 11/2019 | Wilson et al. |
| 10,526,617 B2 | 1/2020 | Gao et al. |
| 10,550,405 B2 | 2/2020 | Li et al. |
| 10,934,560 B2 | 3/2021 | Li et al. |
| 11,118,192 B2 | 9/2021 | Kirn et al. |
| 11,149,256 B2 | 10/2021 | Gradinaru et al. |
| 11,384,364 B2 | 7/2022 | Zolotukhin et al. |
| 11,499,165 B2 | 11/2022 | Deverman et al. |
| 11,566,243 B2 | 1/2023 | Brar et al. |
| 11,781,156 B2 | 10/2023 | Yang et al. |
| 12,049,648 B2 | 7/2024 | Gradinaru et al. |
| 12,104,165 B2 | 10/2024 | Reid |
| 2003/0022870 A1 | 1/2003 | Dzau et al. |
| 2003/0138772 A1* | 7/2003 | Gao ..................... C07K 14/005 435/456 |
| 2004/0265955 A1 | 12/2004 | Fang et al. |
| 2005/0255089 A1 | 11/2005 | Chiorini et al. |
| 2007/0161031 A1 | 7/2007 | Trinklein et al. |
| 2011/0104679 A1 | 5/2011 | DeAngelis et al. |
| 2011/0296544 A1 | 12/2011 | Domon et al. |
| 2011/0301073 A1 | 12/2011 | Gregory et al. |
| 2013/0216503 A1 | 8/2013 | Srivastava et al. |
| 2014/0301991 A1 | 10/2014 | Srivastava et al. |
| 2014/0335063 A1 | 11/2014 | Cannon et al. |
| 2016/0022836 A1 | 1/2016 | Banfi et al. |
| 2016/0186141 A1 | 6/2016 | Cao et al. |
| 2016/0237430 A1 | 8/2016 | Seidman et al. |
| 2016/0251624 A1 | 9/2016 | Wang et al. |
| 2016/0340393 A1 | 11/2016 | Schaffer et al. |
| 2017/0016066 A1 | 1/2017 | Feldman et al. |
| 2018/0066285 A1 | 3/2018 | Ojala et al. |
| 2018/0112282 A1 | 4/2018 | Mohamed et al. |
| 2018/0296703 A1 | 10/2018 | Feldman et al. |
| 2018/0305689 A1 | 10/2018 | Saetrom et al. |
| 2018/0360992 A1 | 12/2018 | Patel et al. |
| 2019/0169237 A1 | 6/2019 | Schaffer et al. |
| 2019/0241622 A1 | 8/2019 | Ito et al. |
| 2019/0241633 A1 | 8/2019 | Fotin-Mleczek et al. |
| 2020/0370137 A1 | 11/2020 | McGovern et al. |
| 2021/0024956 A1 | 1/2021 | Sheikh et al. |
| 2021/0077552 A1 | 3/2021 | Schaffer et al. |
| 2021/0147873 A1 | 5/2021 | Zhu et al. |
| 2021/0147877 A1 | 5/2021 | Li et al. |
| 2021/0284699 A1 | 9/2021 | Gradinaru et al. |
| 2021/0380643 A1 | 12/2021 | Kirn et al. |
| 2022/0064675 A1 | 3/2022 | McCoy et al. |
| 2022/0106612 A1 | 4/2022 | Linden |
| 2022/0112517 A1 | 4/2022 | Yang et al. |
| 2022/0119775 A1 | 4/2022 | Gradinaru et al. |
| 2022/0154217 A1 | 5/2022 | Reid |
| 2022/0168446 A1 | 6/2022 | Herzog et al. |
| 2022/0168447 A1 | 6/2022 | Herzog et al. |
| 2022/0177881 A1 | 6/2022 | Momen-Heravi |
| 2022/0249697 A1 | 8/2022 | Liu et al. |
| 2022/0251145 A1 | 8/2022 | Kirn et al. |
| 2022/0273818 A1 | 9/2022 | Maeder et al. |
| 2022/0306696 A1 | 9/2022 | Strelkova et al. |
| 2022/0372512 A1 | 11/2022 | Lisowski et al. |
| 2022/0403414 A1 | 12/2022 | Ji et al. |
| 2023/0041648 A1 | 2/2023 | Yang et al. |
| 2023/0051968 A1 | 2/2023 | Yang et al. |
| 2023/0056066 A1 | 2/2023 | Yang et al. |
| 2023/0330263 A1 | 10/2023 | Yang et al. |
| 2024/0084327 A1 | 3/2024 | Reid |

FOREIGN PATENT DOCUMENTS

| | | |
|---|---|---|
| EP | 3387137 B1 | 2/2021 |
| EP | 3941929 A1 | 1/2022 |
| EP | 3959226 A2 | 3/2022 |
| EP | 4019642 A1 | 6/2022 |
| EP | 4045664 A1 | 8/2022 |
| EP | 3856913 A4 | 10/2022 |
| JP | 2016513477 A | 5/2016 |
| WO | WO-9303769 A1 | 3/1993 |
| WO | WO-9309239 A1 | 5/1993 |
| WO | WO-9319191 A1 | 9/1993 |
| WO | WO-9407529 A1 | 4/1994 |
| WO | WO-9412649 A2 | 6/1994 |
| WO | WO-9428938 A1 | 12/1994 |
| WO | WO-9500655 A1 | 1/1995 |
| WO | WO-9511984 A2 | 5/1995 |
| WO | WO-9513392 A1 | 5/1995 |
| WO | WO-9811244 A2 | 3/1998 |
| WO | WO-9961601 A2 | 12/1999 |
| WO | WO-0028061 A2 | 5/2000 |
| WO | WO-0111034 A2 | 2/2001 |
| WO | WO-0183692 A2 | 11/2001 |
| WO | WO-0192551 A2 | 12/2001 |
| WO | WO-03042361 A2 | 5/2003 |
| WO | WO-2007078599 A2 | 7/2007 |
| WO | WO-2008021290 A2 | 2/2008 |
| WO | WO-2008024998 A2 | 2/2008 |
| WO | WO-2009104964 A1 | 8/2009 |
| WO | WO-2010129021 A1 | 11/2010 |
| WO | WO-2011020710 A2 | 2/2011 |
| WO | WO-2012145601 A2 | 10/2012 |
| WO | WO-2013063379 A1 | 5/2013 |
| WO | WO-2014144229 A1 | 9/2014 |
| WO | WO-2015031686 A1 | 3/2015 |
| WO | WO-2015162161 A1 | 10/2015 |
| WO | WO-2016133917 A1 | 8/2016 |
| WO | 2016141078 * | 9/2016 |
| WO | WO-2017075627 A1 | 5/2017 |
| WO | WO-2017100671 A1 | 6/2017 |
| WO | WO-2017173137 A1 | 10/2017 |
| WO | WO-2017197355 A2 | 11/2017 |
| WO | WO-2017201121 A1 | 11/2017 |
| WO | WO-2018005546 A1 | 1/2018 |
| WO | WO-2018222503 A1 | 12/2018 |
| WO | WO-2019052057 A1 | 3/2019 |
| WO | WO-2019060454 A2 | 3/2019 |
| WO | WO-2019060619 A1 | 3/2019 |
| WO | WO-2019195444 A1 | 10/2019 |
| WO | WO-2019207132 A1 | 10/2019 |
| WO | WO-2020047467 A2 | 3/2020 |
| WO | WO-2020068990 A1 | 4/2020 |
| WO | WO-2020152210 A1 | 7/2020 |
| WO | WO-2020191300 A1 | 9/2020 |
| WO | WO-2020193698 A1 | 10/2020 |
| WO | WO-2020205889 A1 | 10/2020 |
| WO | WO-2020219988 A2 | 10/2020 |
| WO | WO-2020223279 A1 | 11/2020 |
| WO | WO-2021034222 A1 | 2/2021 |
| WO | WO-2021053222 A1 | 3/2021 |
| WO | WO-2021073568 A1 | 4/2021 |
| WO | WO-2021110995 A1 | 6/2021 |
| WO | WO-2021127655 A1 | 6/2021 |
| WO | WO-2021187380 A1 | 9/2021 |
| WO | WO-2022031914 A2 | 2/2022 |
| WO | WO-2022032226 A1 | 2/2022 |
| WO | WO-2022038140 A1 | 2/2022 |
| WO | WO-2022066898 A2 | 3/2022 |
| WO | WO-2022074105 A1 | 4/2022 |
| WO | WO-2022076648 A1 | 4/2022 |
| WO | WO-2022079082 A1 | 4/2022 |
| WO | WO-2022098765 A1 | 5/2022 |
| WO | WO-2022119871 A2 | 6/2022 |
| WO | WO-2022119974 A1 | 6/2022 |
| WO | WO-2022119979 A1 | 6/2022 |

(56)        References Cited

FOREIGN PATENT DOCUMENTS

| WO | WO-2022136655 A1 | 6/2022 |
|----|------------------|--------|
| WO | WO-2022173847 A2 | 8/2022 |
| WO | WO-2022195074 A2 | 9/2022 |
| WO | WO-2022200858 A1 | 9/2022 |
| WO | WO-2022216574 A1 | 10/2022 |
| WO | WO-2022217222 A2 | 10/2022 |
| WO | WO-2022226263 A1 | 10/2022 |
| WO | WO-2022229807 A1 | 11/2022 |
| WO | WO-2023200736 A2 | 10/2023 |
| WO | WO-2023200742 A2 | 10/2023 |

OTHER PUBLICATIONS

GenBank Accession No. AAB95450, "capsid protein VP1 [Adeno-associated virus—6]," Jan. 12, 1998, 2 pages.
GenBank Accession No. AAD13756, "capsid protein [adeno-associated virus 5]," Feb. 9, 1999, 2 pages.
GenBank Accession No. AAS99264, "capsid protein VP1 [Adeno-associated virus 9]," Jun. 24, 2004, 2 pages.
GenBank Accession No. AAT46337, "capsid protein [Adeno-associated virus 10]," Nov. 30, 2004, 2 pages.
GenBank Accession No. AF043303, "Adeno-associated virus 2, complete genome," May 20, 2010, 5 pages.
GenBank Accession No. AF063497, "Adeno-associated virus 1, complete genome," Apr. 27, 1999, 3 pages.
GenBank Accession No. AF513851, "Adeno-associated virus 7 nonstructural protein and capsid protein genes, complete cds," Sep. 5, 2002, 4 pages.
GenBank Accession No. AF513852, "Adeno-associated virus 8 nonstructural protein and capsid protein genes, complete cds," Sep. 5, 2002, 4 pages.
GenBank Accession No. NC_001401, "Adeno-associated virus 2, complete genome," Aug. 13, 2018, 10 pages.
Genbank Accession No. NC_001729, "Adeno-associated virus—3, complete genome," Aug. 13, 2018, 3 pages.
GenBank Accession No. NC_001829, "adeno-associated Virus—4, complete genome," Aug. 13, 2018, 5 pages.
GenBank Accession No. NC-002077, "Adeno-associated virus—1, complete genome," Aug. 13, 2018, 5 pages.
GenBank Accession No. NC_006152, "Adeno-associated virus 5, complete genome," Aug. 13, 2018, 5 pages.
GenBank Accession No. NC_006261, "Adeno-associated virus—8, complete genome," Aug. 13, 2018, 5 pages.
GenBank Accession No. NP_044927, "capsid [Adeno-associated Virus—4]," Aug. 13, 2018, 3 pages.
GenBank Accession No. NP_049542, "capsid protein [Adeno-associated virus—1]," Aug. 13, 2018, 2 pages.
GenBank Accession No. U89790, "Adeno-associated virus 4, complete genome," Aug. 21, 1997, 4 pages.
GenBank Accession No. YP_077178, "capsid protein [Adeno-associated virus—7]," Aug. 13, 2018, 2 pages.
GenBank Accession No. YP_077180, "capsid protein [Adeno-associated virus—8]," Aug. 13, 2018, 2 pages.
Georg-Fries, B et al., "Analysis of proteins, helper dependence, and seroepidemiology of a new human parvovirus," Virology, vol. 134, pp. 64-71 (1984).
Govindasamy et al., "Structural Insights into Adeno-Associated Virus Serotype 5," Journal of Virology, vol. 87, No. 20, pp. 11187-11199 (Oct. 2013).
Govindasamy, L. et al., "Structurally Mapping the Diverse Phenotype of Adeno-Associated Virus Serotype 4," Journal of Virology, vol. 80, No. 23, pp. 11556-11570 (Dec. 2006).
Kyöstiö, S. R. M. et al., "Analysis of Adeno-Associated Virus (AAV) Wild-Type and Mutant Rep Proteins for Their Abilities to Negatively Regulate AAV p5 and p19 mRNA levels," Journal of Virology, vol. 68, No. 5, pp. 2947-2957 (May 1994).
Marsic, D. et al., "Vector Design Tour de Force: Integrating Combinatorial and Rational Approaches to Derive Novel Adeno-associated Virus Variants," Molecular Therapy, Nov. 2014, vol. 22, No. 11, pp. 1900-1909.

McCarty, D.M., "Self-complementary AAV vectors; Advances and Applications," Molecular Therapy, vol. 16, No. 10, pp. 1648-1656 (Oct. 2008).
Mori, et al., "Two novel adeno-associated viruses from cynomolgus monkey: pseudotyping characterization of capsid protein," Virology, 330, pp. 375-383 (2004).
Muramatsu, et al., "Nucleotide Sequencing and Generation of an Infectious Clone of Adeno-Associated Virus 3," Virology 221, pp. 208-217 (1996) Article No. 0367.
Muzyczka, N. "Use of adeno-Associated Virus as a General Transduction Vector for Mammalian Cells," Current Topics in Microbiology and Immunology 158:97-129 (1992).
Nam et al. "Structure of Adeno-Associated Virus Serotype 8, a Gene Therapy Vector" Journal of Virology, vol. 81, No. 22, pp. 12260-12271 (Nov. 2007).
Padron, E. et al. "Structure of Adeno-Associated Virus Type 4" Journal of Virology, vol. 79, No. 8, pp. 5047-5058 (Apr. 2005).
Prasad, K. M., et al., "Characterization of the Rep78/Adeno-Associated Virus Complex," Virology, vol. 229, pp. 183-192 (1997), Article No. VY968431.
Santiago-Ortiz, et al., "AAV ancestral reconstruction library enables selection of broadly infectious viral variants," Gene Therapy (2015), 22, 934-946, doi:10.1038/gt.2015.74, Epub Jul. 17, 2015.
Shade, R.O., et al. "Nucleotide Sequence and Genome Organization of Human Parvovirus B19 Isolated from the Serum of a Child during Aplastic Crisis," Journal of Virology, Jun. 1986, vol. 58, No. 3, pp. 921-936.
Shen, X. et al. "Characterization of the Relationship of AAV Capsid Domain Swapping to Liver Transduction Efficiency," Molecular Therapy, vol. 15, No. 11, pp. 1955-1962 (Nov. 2007), doi:10.1038/sj.mt.6300293.
Srivistava, A., et al., "Nucleotide Sequence and Organization of the Adeno-Associated Virus 2 Genome," Journal of Virology, vol. 45, No. 2, pp. 555-564 (Feb. 1983).
Van Vliet, K. et al., "Proteolytic Mapping of the Adeno-associated Virus Capsid," Molecular Therapy, vol. 14, No. 6, pp. 809-821 (Dec. 2006), doi:10.1016/j.ymthe.2006.08.1222.
Wu, Z. et al., "Effect of Genome Size on AAV Vector Packaging," Molecular Therapy, vol. 18, No. 1, pp. 80-86 (Jan. 2010).
Xiao, W. et al., "Gene Therapy Vectors Based on Adeno-Associated Virus Type 1," Journal of Virology, vol. 73, No. 5, pp. 3994-4003 (May 1999).
Xie, Q. et al., "The atomic structure of adeno-associated virus (AAV-2), a vector for human gene therapy," Proceeding of the National Academy of Sciences, vol. 99, No. 16, pp. 10405-10410 (Aug. 2002), doi:10.1073/pnas.162250899.
Addis et al. Optimization of direct fibroblast reprogramming to cardiomyocytes using calcium activity as a functional measure of success. J Mol Cell Cardiol 60:97-106 (2013).
Akdis et al. Myocardial expression profiles of candidate molecules in patients with arrhythmogenic right ventricular cardiomyopathy/dysplasia compared to those with dilated cardiomyopathy and healthy controls. Heart Rhythm 13(3):731-741 (2016).
Ali et al. Adena-associated virus gene transfer to mouse retina. Hum Gene Ther 9:81- 86 (1998).
Ali et al. Gene transfer into the mouse retina mediated by an adeno-associated viral vector. Hum Mol Genet 5:591-594 (1996).
Asimaki et al. A New Diagnostic Test for Arrhythmogenic Right Ventricular Cardiomyopathy. N Engl J Med 360(11):1075-84 (2009).
Asokan et al. An emerging adeno-associated viral vector pipeline for cardiac gene therapy. Hum Gene Ther. 24:906-13 (2013).
Balaji et al. Pseudotyped adeno-associated viral vectors for gene transfer in dermal fibroblasts: implications for wound-healing applications. J Surg Res. 184:691-98 (2013).
Bellaiche et al. I-Scel Endonuclease, a New Tool for Studying DNA Double-Strand Break Repair Mechanisms in Drosophila. Genetics 152:1037-1044 (1999).
Bennett et al. Real-time, noninvasive in vivo assessment of adeno-associated virus- mediated retinal transduction. Invest Ophthalmol Vis Sci. 38(13):2857-2863 (1997).
Bitter et al. Expression and secretion vectors for yeast. Methods Enzymol 153:516-544 (1987).

(56)                    References Cited

OTHER PUBLICATIONS

Blomer et al. Highly efficient and sustained gene transfer in adult neurons with a lentivirus vector. J Virol. 71 (9) :6641-6649, 1997.

Borras et al. Adenoviral reporter gene transfer to the human trabecular meshwork does not alter aqueous humor outflow. Relevance for potential gene therapy of glaucoma. Gene Ther 6(4):515-524 (1999).

Bradford., et al., Plakophilin2 gene therapy prevents and rescues arrhythmogenic right ventricular cardiomyopathy in a mouse model harboring patient genetics, Nature Cardiovascular Research, 2023, pp. 1246-1261.

Brodehl et al. Human Induced Pluripotent Stem-Cell-Derived Cardiomyocytes as Models for Genetic Cardiomyopathies. Int. J. Mol. Sci. 20:4381 (2019), 56 pages.

Brodehl et al. Molecular insights into cardiomyopathies associated with desmin (DES) mutations. Biophysical Reviews 10:983-1006 (2018).

Burke et al. Arrhythmogenic right ventricular cardiomyopathy and fatty replacement of the right ventricular myocardium: are they different diseases? Circulation 97(16):1571-1580 (1998).

Cerrone et al. Plakophilin-2 is required for transcription of genes that control calcium cycling and cardiac rhythm. Nat Commun 8(1):106 (2017), 16 pages.

Chamberlain et al. Cardiac Gene Therapy with Adeno-Associated Virus-Based Vectors. Curr Opin Cardiol 32(3):275-282 (2017).

Christoforou et al. Transcription factors MYOCD, SRF, Mesp1 and SMARCD3 enhance the cardio-inducing effect of GATA4, TBX5, and MEF2C during direct cellular reprogramming. PLoS One 8:e63577 (2013), 19 pages.

Chu, D et al., "Gene delivery to the mammalian heart using AAV vectors," Methods Mol Biol, 246:213-224 (2004).

Chu et al. SV40 DNA transfection of cells in suspension: analysis of efficiency of transcription and translation of T-antigen. Gene 13:197-202 (1981).

Cotten et al. High-efficiency receptor-mediated delivery of small and large (48 kilobase gene constructs using the endosome-disruption activity of defective or chemically inactivated adenovirus particles. PNAS USA 89(13):6094-6098 (1992).

Cruz et al. Exercise triggers ARVC phenotype in mice expressing a disease-causing mutated version of human plakophilin-2. J Am Coll Cardiol 65(14):1438-1450 (2015).

Curiel et al. High-efficiency gene transfer employing adenovirus-polylysine-DNA complexes. Nat Immun 13(2-3):141-64 (1994).

Daya et al., "Gene therapy using adeno-associated virus vectors." Clin Microbial Rev. Oct. 2008; 21(4): 583-593.

De et al. High levels of persistent expression of alpha1-antitrypsin mediated by the nonhuman primate serotype rh.10 adeno-associated virus despite preexisting immunity to common human adeno-associated viruses. Mol. Ther. 13(1):67-76 (2006).

Dull et al. A third-generation lentivirus vector with a conditional packaging system. J Virol 71 (11):8463-8471 (1998).

Dziennis et al. The CD11 b promoter directs high-level expression of reporter genes in macrophages in transgenic mice. Blood 85(2):319-329 (1995).

Faust et al. Insertion of enhanced green fluorescent protein into the lysozyme gene creates mice with green fluorescent granulocytes and macrophages. Blood 96(2):719-726 (2000).

Flannery et al. Efficient photoreceptor-targeted gene expression in vivo by recombinant adeno-associated virus. PNAS USA 94(13):6916-6921 (1997).

Flotte et al. Stable in vivo expression of the cystic fibrosis transmembrane conductance regulator with an adeno-associated virus vector. PNAS USA 90(22):10613-10617 (1993).

Franz et al. Analysis of tissue-specific gene delivery by recombinant adenoviruses containing cardiac-specific promoters. Cardiovasc. Res. 35:560-566 (1997).

Fu et al. Direct reprogramming of human fibroblasts toward a cardiomyocyte-like state. Stem Cell Reports 1 :235-247 (2013).

Gao et al.: Clades of Adeno-associated viruses are widely disseminated in human tissues. J Virol. 78(12): 6381-6388 (2004).

Gerull et al. Genetic Animal Models for Arrhythmogenic Cardiomyopathy. Front Physiol 11 :624 (2020), 20 pages.

Graham et al. A new technique for the assay of infectivity of human adenovirus 5 DNA. Virology 52:456-467 (1973).

Grainger et al. 870. Transfection of Mammalian Cells Using Linear Polyethylenimine Is a Simple and Effective Means of Producing Recombinant AAV. Mol Ther 11 :S337 (2005), 2 pages.

Green et al. Desmosomes: Essential contributors to an integrated intercellular junction network. F1000Res F1000 Faculty Rev-2150 (2019), 16 pages.

He et al. Development of a synthetic promoter for macrophage gene therapy. Hum Gene Ther 17:949-959 (2006).

Heath et al. The structure of I-CreI, a Group I intron-encoded homing endonuclease. Nat Struct Biol 4:468 (1997), 9 pages.

Hu et al., MicroRNA-302 increases reprogramming efficiency via repression of NR2F2. Stem Cells 31 (2):259-68 (2013).

Hunter et al. Targeting gene expression to specific cardiovascular cell types in transgenic mice. Hypertension 22:608-617 (1993).

Ieda et al.: Direct reprogramming of fibroblasts into functional cardiomyocytes by defined factors. Cell. 142(3):375-386 (2010).

Ishikawa., et al., Human Cardiac Gene Therapy, Circulation Research, 2018, pp. 601-613.

Jayawardena et al. MicroRNA-Mediated In Vitro and In Vivo Direct Reprogramming of Cardiac Fibroblasts to Cardiomyocytes, Circ. Res. 110:1465-1473 (2012).

Jomary et al. Rescue of photoreceptor function by AAV-mediated gene transfer in a mouse model of inherited retinal degeneration. Gene Ther. 4(7):683-690 (1997).

Kanegae et al. Efficient gene activation in mammalian cells by using recombinant adenovirus expressing site-specific Cre recombinase. Nucleic Acids Res 23:3816-3821 (1995).

Karakikes et al. Human Induced Pluripotent Stem Cell-Derived Cardiomyocytes: Insights into Molecular, Cellular, and Functional Phenotypes, Circ Res. 117(1):80-88 (2015).

Katz, M.G. et al., "Cardiac gene therapy: optimization of gene delivery techniques in vivo," Human Gene Therapy, 21:371-380 (2010).

Kelleher et al. Long-term episomal gene delivery in human lymphoid cells using human and avian adenoviral-assisted transfection. Biotechniques 17(6):1110-7 (1994).

Kim et al. Direct reprogramming of mouse fibroblasts to neural progenitors. PNAS USA 108(19):7838-7843 (2011).

Kitamura et al. Retrovirus-mediated gene transfer and expression cloning: powerful tools in functional genomics. Exp Hematol 31:1007-1014 (2003).

Korpela, et al, Gene therapy for ischaemic heart disease and heart failure, Intern Med 2021; 290: 567-582.

Kotterman et al. Engineering adeno-associated viruses for clinical gene therapy. Nature Reviews Genetics 15:445-451 (2014).

Kraus et al. S100A1 in cardiovascular health and disease: closing the gap between basic science and clinical therapy. Mol Cell Cardiol 47:445-455 (2009).

Lee et al. Adenovirus-Mediated Gene Delivery: Potential Applications for Gene and Cell-Based Therapies in the New Era of Personalized Medicine. Genes Dis 4(2):43-63 (2017).

Li et al. In vivo transfer of a reporter gene to the retina mediated by an adenoviral vector. Invest Opthalmol Vis Sci 35:2543-2549 (1994).

Li et al. Phenotype correction in retinal pigment epithelium in murine mucopolysaccharidosis VII by adenovirus-mediated gene transfer. PNAS USA 92:7700-7704 (1995).

Linn et al. Conservation of an AE3 Cl-/HCO3-exchanger cardiac-specific exon and promoter region and AE3 mRNA expression patterns in murine and human hearts. Circ. Res. 76:584-591 (1995).

Macejak et al., Internal initiation of translation mediated by the 5' leader of a cellular mRNA. Nature 353:90-94 (1991).

Mann et al. Construction of a retrovirus packaging mutant and its use to produce helper-free defective retrovirus. Cell 33:153-159 (1983).

Matkar, P. N. et al., "Cardiac gene therapy: are we there yet?" Gene Therapy, 23:635-648 (2016).

Mauro. Codon Optimization in the Production of Recombinant Biotherapeutics: Potential Risks and Considerations. BioDrugs 32:69-81 (2018).

(56)　　　　References Cited

OTHER PUBLICATIONS

Mendelson et al. Expression and rescue of a nonselected marker from an integrated AAV vector. Virology 166(1):154-165 (1988).

Miller et al. Radiation resistance in a doxorubicin-resistant human fibrosarcoma cell line. Am. J. Clin. Oncol. 15(3):216-221 (1992).

Miyoshi et al. Development of a self-inactivating lentivirus vector. J. Virol 72(10):8150-8157 (1998).

Miyoshi et al. Stable and efficient gene transfer into the retina using an HIV-based lentiviral vector. PNAS USA 94(19):10319-10323 (1997).

Moncayo-Arlandi et al. Unmasking the molecular link between arrhythmogenic cardiomyopathy and Brugada syndrome. Nat Rev Cardiol 14(12):744-756 (2017).

Morgenstern et al. Advanced mammalian gene transfer: high titre retroviral vectors with multiple drug selection markers and a complementary helper-free packaging cell line. Nucleic Acids Res. 18(12):3587-3596 (1990).

Morita et al. Plat-E: an efficient and stable system for transient packaging of retroviruses. Gene Therapy 7(12):1063-1066 (2000).

Mura et al. Identification of a PKP2 gene deletion in a family with arrhythmogenic right ventricular cardiomyopathy. Eur J Hum Genet 21 (11):1226-1231 (2003).

Naldini et al. In vivo gene delivery and stable transduction of nondividing cells by a lentiviral vector. Science 272:263-7 (1996).

Naldini et al. Lentiviruses as gene transfer agents for delivery to non-dividing cells. Curr Opin Biotechnol. 9(5):457-463 (1998).

Nam et al. Reprogramming of human fibroblasts toward a cardiac fate. PNAS USA 110:5588-5593 (2003).

Narayanan et al. Preclinical Efficacy of AAVrh.74-PKP2a (RP-A601): Gene Therapy for PKP2-Associated Arrhythmogenic Cardiomyopathy (PKP2-ACM), Molecular Therapy, 26th Annual Meeting of the American Society of Gene and Cell Therapy (ASGCT), May 19, 2023, Late-breaking abstract #02, 13 pages.

Nicolas et al. Chapter 25: Retroviral Vectors. In Vectors: A survey of molecular cloning vectors and their uses Rodriguez and Denhardt eds. Stoneham: Butterworth (pp. 493-513) (1988).

Onishi et al. Applications of retrovirus-mediated expression cloning. Exp Hematol 24:324-329 (1996).

Pacak et al. Tissue specific promoters improve specificity of AAV9 mediated transgene expression following intra-vascular gene delivery in neonatal mice. Genet Vaccines Ther. 6:13 (2008), 5 pages.

Park, Frank, "The heart is where AAV9 lies," Physiol Genomics 54: 316-318, 2022.

Parmacek et al. A novel myogenic regulatory circuit controls slow/cardiac troponin C gene transcription in skeletal muscle. Mol Cell Biol 14:1870-1885 (1994).

Paskind et al. Dependence of Moloney murine leukemia virus production on cell growth. Virology 67:242-248 (1975).

Pelletier et al., Internal initiation of translation of eukaryotic mRNA directed by a sequence derived from poliovirus RNA. Nature 334:320-325 (1988).

Piras et al. Systemic injection of AAV9 carrying a periostin promoter targets gene expression to a myofibroblast-like lineage in mouse hearts after reperfused myocardial infarction. Gene Therapy 23:469-478 (2016).

Powell, S. K., et al., "Viral expression cassette elements to enhance transgene target specificity and expression in gene therapy", Discovery Medicine (2015); 19(102): 49-57.

Pozsgai et al. Systemic AA V-Mediated β-Sarcoglycan Delivery Targeting Cardiac and Skeletal Muscle Ameliorates Histological and Functional Deficits in LGMD2E Mice. Mol Ther. 25:855-69 (2017).

Presnyak et al. Codon optimality is a major determinant of mRNA stability. Cell 160(6):1111-1124 (2015).

Ritterhoff et al., Targeting S100A1 in heart failure. Gene Ther. 19(6):613-621 (2012).

Riviere et al. Effects of retroviral vector design on expression of human adenosine deaminase in murine bone marrow transplant recipients engrafted with genetically modified cells. PNAS USA 92(15):6733-6737 (1995).

Robbins et al. In vivo definition of a cardiac specific promoter and its potential utility in remodeling the heart. Ann. N.Y. Acad. Sci.752:492-505 (1995).

Rolling et al. Evaluation of adeno-associated virus-mediated gene transfer into the rat retina by clinical fluorescence photography. Hum Gene Ther 10:641-648 (1999).

Sakamoto et al. A vitrectomy improves the transfection efficiency of adenoviral vector-mediated gene transfer to Muller cells. Gene Ther. 5(8):1088-1097 (1998).

Samulski et al. Helper-free stocks of recombinant adeno-associated viruses: normal integration does not require viral gene expression. J Virol. 63(9):3822-3828 (1989).

Sartorelli et al. Myocardial activation of the human cardiac α-actin promoter by helix-loop-helix proteins. PNAS USA 89:4047-4051 (1992).

Shanks et al., "Are animal models predictive for humans?", Philosophy, Ethics, and Humanities in Medicine, 2009, pp. 1-20.

Shpaer. GeneAssist. Smith-Waterman and other database similarity searches and identification of motifs. Methods Mol Biol 70:173-187 (1997).

Singh., et al., A Review on Arrhythmogenic Right Ventricular Cardiomyopathy—Pathogenesis, Diagnosis and Treatment Modalities, International Journal of Research Publication and Reviews, vol. 3, No. 12, pp. 2448-2455, Dec. 2022.

Takahashi et al. Rescue from photoreceptor degeneration in the rd mouse by human immunodeficiency virus vector-mediated gene transfer. J Virol 73:7812-7816 (1999).

Temin. Chapter 6: Retrovirus Vectors for Gene Transfer: Efficient Integration into and Expression of Exogenous DNA in Vertebrate Cell Genomes. Gene Transfer Kucherlapati (ed.) New York: Plenum Press (pp. 149-188) (1986).

Wada et al. Induction of human cardiomyocyte-like cells from fibroblasts by defined factors. PNAS USA 110:12667-12672 (2013).

Wang et al. Diagnostic and therapeutic strategies for arrhythmogenic right ventricular dysplasia/cardiomyopathy patient. Europace 21 (1):9-21 (2018).

Wu et al. Cardiac AAV:PKP2 Gene Therapy Reduces Ventricular Arrhythmias, Reverses Adverse Right Ventricular Remodeling, Improves Heart Function, and Extends Survival in a Pkp2-deficient Mouse Model of Arrhythmogenic Right Ventricular Cardiomyopathy Poster (2022), 1 page. Retrieved from the Internet on Jul. 17, 2023: https://www.tenayatherapeutics.com/wp-content/uploads/PKP2-Gene-Therapy-for-Arrhythmogenic-Right-Ventricular-Cardiomyopathy.pdf.

Yee et al. A General Method for the Generation of High-Titer, Pantropic Retroviral Vectors: Highly Efficient Infection of Primary Hepatocytes. PNAS USA 91 :9564-9568 (1994), 5 pages.

Zolotukhin et al. Recombinant adeno-associated virus purification using novel methods improves infectious titer and yield. Gene Ther 6:973-985 (1999).

Zufferey et al. Multiply attenuated lentiviral vector achieves efficient gene delivery in vivo. Nat Biotechnol 15(9):871-875 (1997).

Bogner, et al., "Capsid Mutated Adeno-Associated Virus Delivered to the Anterior Chamber Results in Efficient Transduction of Trabecular Meshwork in Mouse and Rat," PLoS One. Jun. 8, 2015; 10(6):e0128759, 16 pages.

Hirai, et al., "Accelerated direct reprogramming of fibroblasts into cardiomyocyte-like cells with the MyoD transactivation domain," Cardiovasc Res. Oct. 1, 2013; 100(1):105-13. Epub Jun. 20, 2013.

Rasmussen, et al., "Truncating plakophilin-2 mutations in arrhythmogenic cardiomyopathy are associated with protein haploinsufficiency in both myocardium and epidermis," Circ Cardiovasc Genet. Jun. 2014; 7(3):230-40. Epub Apr. 4, 2014.

Van Opbergen, et al., "AAV-Mediated Delivery of Plakophilin-2a Arrests Progression of Arrhythmogenic Right Ventricular Cardiomyopathy in Murine Hearts: Preclinical Evidence Supporting Gene Therapy in Humans," Circ Genom Precis Med. Feb. 2024; 17(1):e004305, 12 pages. Epub Jan. 30, 2024.

Van Opbergen, et al., "Plakophilin-2 Haploinsufficiency Causes Calcium Handling Deficits and Modulates the Cardiac Response Towards Stress," Int J Mol Sci. Aug. 21, 2019; 20(17):4076, pp. 1-21.

(56) References Cited

OTHER PUBLICATIONS

Wu, et al., "Cardiac AAV9:PKP2 Gene Therapy Reduces Ventricular Arrhythmias, Reverses Adverse Remodeling, and Reduces Mortality in a Mouse Model of ARVC," Research Square 2023, 42 pages retrieved online at: https://assets-eu.researchsquare.com/files/rs-2958419/v1_covered_25e51c66-f070-4b44-82ed-63eeb88f97b3.pdf?c=1710832063.

\* cited by examiner

Parental Library 267,612 (97.6%)

hCF Enriched Variants: Round 1

143,161 (87.5%)

hCF Enriched Variants: Round 2

254,930 (58.2%)

hCF Enriched Variants: Round 3

215,469 (41.5%)

FIG. 4A
FIG. 4D
FIG. 4C
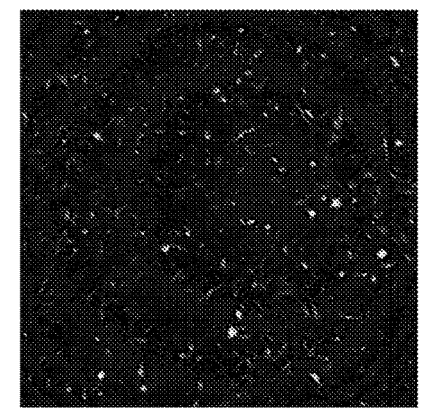
FIG. 4B

FIG. 5D
Mean Fluorescence Intensity
5-Fold
AAV5          AAV5.CR23
FIG. 5C
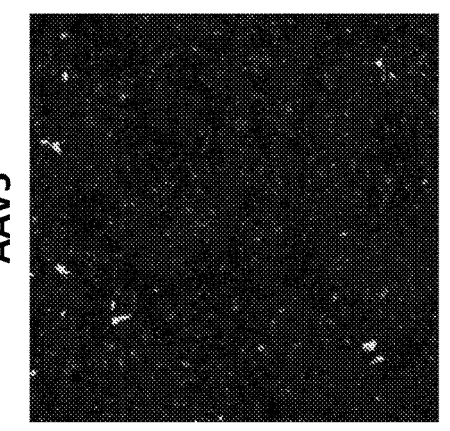
AAV5.CR23
FIG. 5A
Relative hiPSC-CM Transduction
AAV5.CR2
AAV5.CR5
AAV5.CR8
AAV5.CR17
AAV5.CR18
AAV5.CR19
AAV5.CR20
AAV5.CR21
AAV5.CR22
AAV5.CR23
AAV5.CR24
AAV5.CR25
AAV5.CR26
AAV5.CR27
AAV5.CR28
AAV5
FIG. 5B
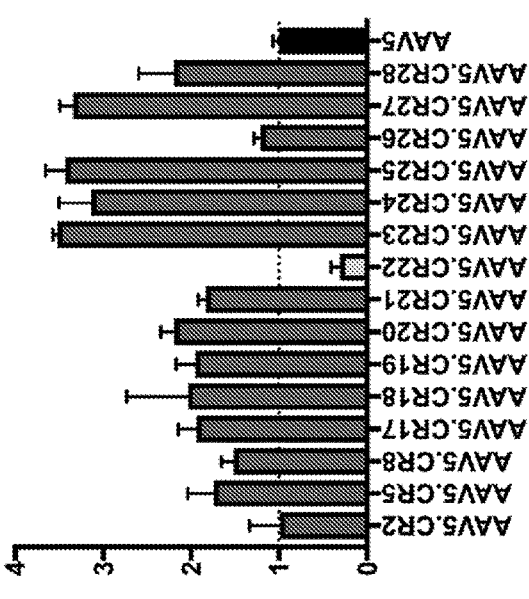
AAV5

ADENO-ASSOCIATED VIRUS WITH ENGINEERED CAPSID

CROSS-REFERENCE TO RELATED APPLICATIONS

This application is a national phase filing under 35 U.S.C. § 371 of International Application No. PCT/US2020/026009, filed Mar. 31, 2020, which claims the benefit of priority to U.S. Provisional Application No. 62/984,197, filed Mar. 2, 2020, and U.S. Provisional Application No. 62/827,576, filed Apr. 1, 2019, the disclosures of which are incorporated by reference in their entireties for all purposes.

FIELD OF THE INVENTION

The present disclosure relates generally to gene therapy with adeno-associated virus vectors. In particular, the disclosure relates to recombinant adeno-associated virus virions having an engineered capsid protein.

REFERENCE TO SEQUENCE LISTING

This application is being filed electronically via EFS-Web and includes an electronically submitted sequence listing in .txt format. The .txt file contains a sequence listing entitled "TENA_012_02_US_SeqList_ST25.txt" created on Sep. 28, 2021 and having a size of ~2,590 kilobytes. The sequence listing contained in this .txt file is part of the specification and is incorporated herein by reference in its entirety.

BACKGROUND

Adeno-associated virus (AAV) holds promise for gene therapy and other biomedical applications. In particular, AAV can be used to deliver gene products to various tissues and cells, both in vitro and in vivo. The capid proteins of AAV largely determine the immunogenicity and tropism of AAV vectors.

For some tissues, AAV subtype 5 (AAV5) is a preferred AAV vector due to the low prevalence of neutralizing antibodies against AAV5 in human populations. AAV5 transduces cardiac tissues less effectively, however, than other AAV subtypes. In addition, selective transduction of different cell types is desirable but difficult to achieve. For example, in some applications, transduction of cardiac fibroblasts rather than cardiac myocytes, or vice-versa, may be desirable. The present disclosure provides variants of the AAV5 capsid that form rAAV virions capable of transducing cardiac tissues and/or cell types for more efficiently and/or with more selectivity than rAAV virions comprising wild-type AAV5 capsid proteins.

SUMMARY OF THE DISCLOSURE

In one aspect, the disclosure provides a recombinant adeno-associated virus (rAAV) virion, comprising an AAV5 capsid protein, wherein the capsid protein comprises one or more substitutions selected from S651A, S651G, S651V, S651L, S651I, T578A, T578G, T578V, T578L, T578I, T582A, T582G, T582V, T582L, or T582I compared to a parental AAV5 capsid; and a heterologous nucleic acid comprising a nucleotide sequence encoding a gene product.

In another aspect, the disclosure provides an AAV5 capsid protein comprising one or more substitutions selected from S651A or S651V; T578A or T578V; or T582A or T582V compared to a parental AAV5 capsid.

In another aspect, the disclosure provides recombinant adeno-associated virus (rAAV) virion, comprising an AAV5 capsid protein, wherein the capsid protein comprises an insertion with respect to a parental sequence of 5 to 11 amino acids at an insertion site in the GH loop of the parental sequence; and a heterologous nucleic acid comprising a nucleotide sequence encoding a gene product.

In another aspect, the disclosure provides an AAV5 capsid protein, wherein the capsid protein comprises an insertion with respect to a parental sequence of 5 to 11 amino acids at an insertion site in the GH loop of the parental sequence.

In a further aspect, the disclosure provides a polynucleotide encoding the AAV5 capsid protein, wherein the capsid protein comprises an insertion with respect to a parental sequence of 5 to 11 amino acids at an insertion site in the GH loop of the parental sequence.

In a further aspect, the disclosure provides a pharmaceutical composition comprising an rAAV virion comprising an AAV5 capsid protein, wherein the capsid protein comprises an insertion with respect to a parental sequence of 5 to 11 amino acids at an insertion site in the GH loop of the parental sequence; and a heterologous nucleic acid comprising a nucleotide sequence encoding a gene product.

In a further aspect, the disclosure provides method of transducing a cardiac cell, comprising contacting the cardiac cell with an rAAV virion of the disclosure, wherein the rAAV virion transduces the cardiac cell.

In a further aspect, the disclosure provides a method of delivering one or more gene products to a cardiac cell, comprising contacting the cardiac cell with an rAAV virion of the disclosure, wherein the cardiac cell expresses the gene product.

In a further aspect, the disclosure provides a method of treating a cardiac pathology in a subject in need thereof, comprising administering a therapeutically effective amount of a pharmaceutical composition comprising an rAAV virion of the disclosure, wherein the rAAV virion transduces cardiac tissue.

In a further aspect, the disclosure provides a method of identifying AAV capsid proteins that confer on rAAV virions increased transduction efficiency in target cells, comprising providing a population of rAAV virions whose rAAV genomes comprise a library of cap polynucleotides encoding variant AAV capsid proteins; contacting the population with target cells for a time sufficient to permit transduction of the cap polynucleotide into the target cells by the rAAV virions; and sequencing the cap polynucleotides from the target cells, thereby identifying AAV capsid proteins that confer increased transduction efficiency in the target cells.

BRIEF DESCRIPTION OF THE DRAWINGS

FIG. 2A shows a schematic of an AAV genome comprising the rep gene of AAV2 ("Rep2") and the cap gene of AAV ("Cap5") flanked by 3' and 5' inverted terminal repeats (ITRs). In this embodiment, a random 7-mer polypeptide library flanked by alanine residues (AXXXXXXXA; SEQ ID NO: 100) is inserted at position 575 as indicated. FIG. 2B shows the structure of the AAV5 capsid. The approximate insertion site for polypeptide library (in one of the 60 copies of the capsid protein shown) is indicated by a black arrow.

FIGS. 4A-4D shows transduction efficiency for hCF cells of various rAAV virions identified using the library screening strategy. FIG. 4A shows transduction efficiency of fifteen AAV5 variants benchmarked against unmodified AAV5 (right most bar) packaging a green fluorescent protein (GFP) reporter transgene. hCFs were infected at a genomic multiplicity of infection (MOI) of 100,000 and the percentage of GFP positive cells were quantified using the Cytation 5™ cell imaging multi-mode reader. Representative fluorescent images are shown for hCFs transduced by either unmodified AAV5 (FIG. 4B) or AAV5.CR17 (FIG. 4C). FIG. 4D shows transduction efficiency of unmodified AAV5 versus AAV.CR17 at MOI of 1,000.

FIGS. 5A-5D shows transduction efficiency for iPS-CM cells of various rAAV virions identified using the library screening strategy. FIG. 5A shows transduction efficiency of fifteen AAV5 variants benchmarked against unmodified AAV5 (right most bar) packaging a GFP reporter transgene. hCFs were infected at a genomic multiplicity of infection (MOI) of 100,000 and the percentage of GFP positive cells were quantified using the Cytation 5™ cell imaging multi-mode reader. Representative fluorescent images are shown for hCFs transduced by either unmodified AAV5 (FIG. 5B) or AAV5.CR23 (FIG. 5C). FIG. 5D shows transduction efficiency of unmodified AAV5 versus AAV.CR23 at MOI of 100,000.

FIG. 6A shows a histogram and gating of "total GFP" and "high GFP" populations. Increased percent GFP+(FIG. 6B) and GFP intensity (FIG. 6C) were observed in the "total GFP" population when cells were transduced with AAV5.CR17 compared to unmodified AAV5 at MOI of 103, 104, or 105.

Increased percent GFP+(FIG. 6D) and GFP intensity (FIG. 6E) were observed in the "high GFP" population when cells were transduced with AAV5.CF17 compared to unmodified AAV5 at MOI of 103, 104, or 105.

FIGS. 7A-7H show the transduction profile of AAV5 and AAV5.CR17 in CD1 mice with and without myocardial infarction (MI). Unmodified AAV5 exhibited limited transduction of cardiac tissue in control mice (GFP—FIG. 7A; DAPI—FIG. 7B) or induced MI mice (GFP—FIG. 7C; DAPI—FIG. 7D). AAV5.CR17 more effectively transduced cardiac tissue in both control mice (GFP—FIG. 7E; DAPI—FIG. 7F) and induced MI mice (GFP—FIG. 7G; DAPI—FIG. 7H). $1.2 \times 10^{11}$ vg of either AAV5.CAG-GFP or AAV5.CR17.CAG-GFP was injected into 6-week old CD1 mice via an intramyocardial injection. GFP intensity and distribution was assessed 7 days following an injection. Increased cardiomyocyte and fibroblast transduction is observed with AAV5.CR17 in both non-MI and MI animals. All heart tissue sections were imaged using a 20× objective with equal gain and exposure. Anti-GFP immunostaining is shown in green and nuclei counterstaining with DAPI blue is shown in blue.

Figures 8A, 8B, 8C, 8D:
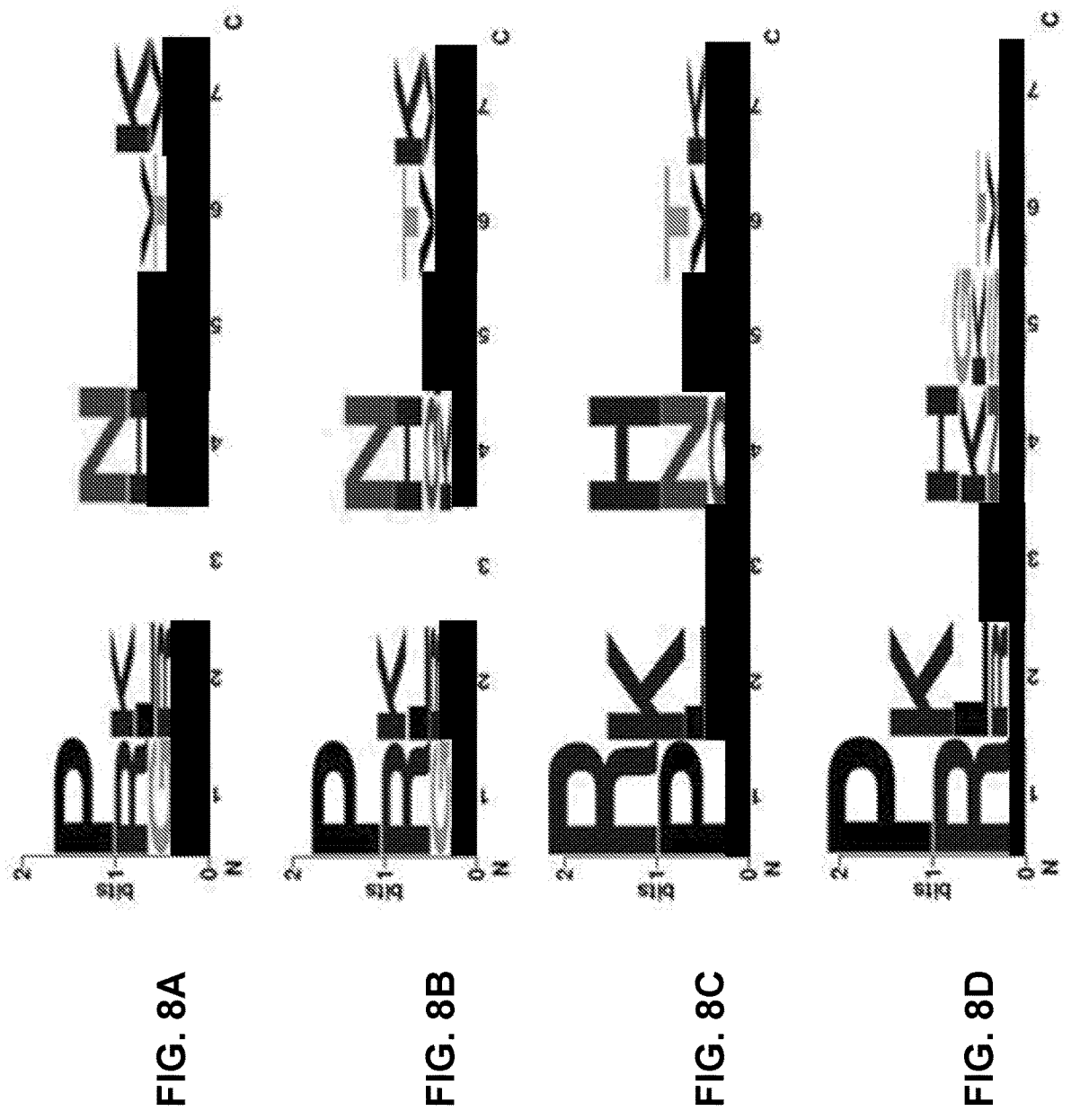
Figure 8E:
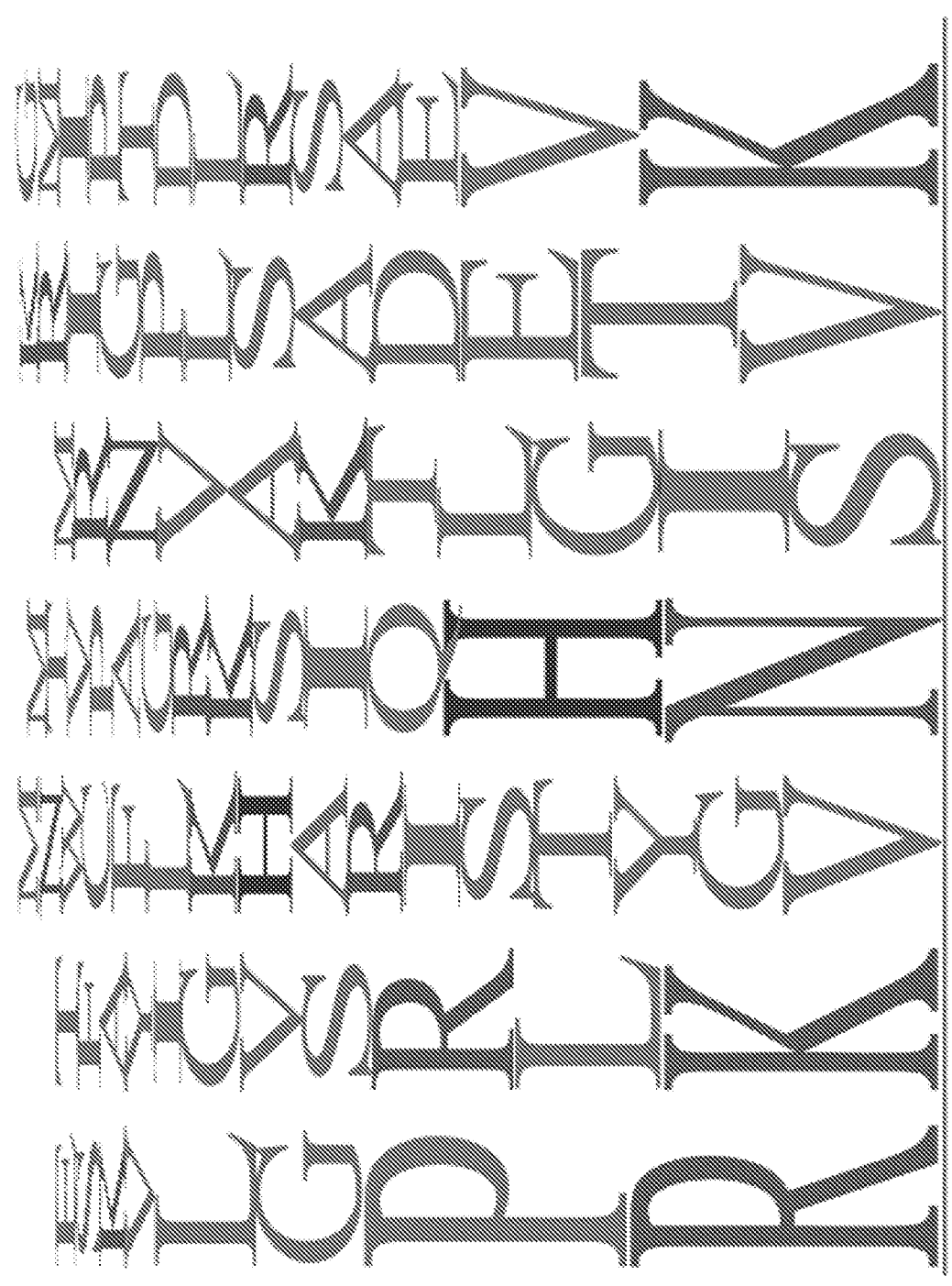

FIGS. 8A-8E show sequence motifs based on the sequence of the top 100 (FIG. 8A), top 50 (FIG. 8B), top 20 (FIG. 8C) sequences in Table 2 (SEQ ID NOs. 101-600), or the sequences with data reported in Table 1 (FIG. 8D) (SEQ ID NOs. 101-115). FIG. 8E shows a sequence motif for all sequence reads in the library weighted by the number of sequence reads in the library after round 3 (SEQ ID NOs. 101-600).

Figure 9:
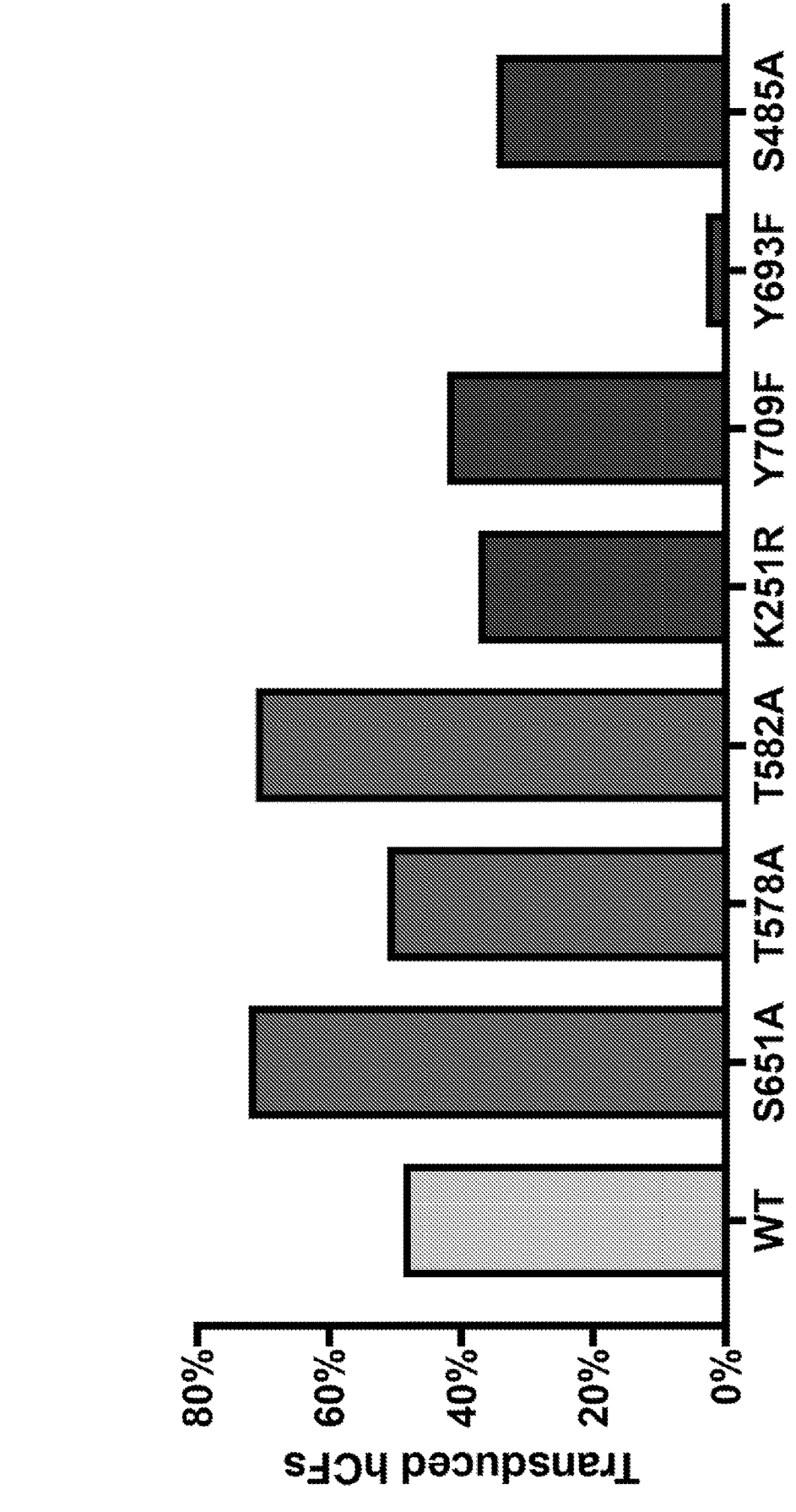

FIG. 9 show AAV5 surface-exposed serine/threonine/lysine/tyrosine mutant vectors demonstrate increased transduction efficiency of hCFs in vitro. hCF cells were infected with either AAV5-wt or AAV5-mutant vectors packaging a ubiquitously expressing GFP reporter. Substitutions S651A, T578A, or T582A in the AAV5 capsid resulted in improved human cardiac fibroblast transduction at an multiplicity of infection of 100,000 vg/cell 72 hours following infection.

Figures 10A, 10B, 10C:
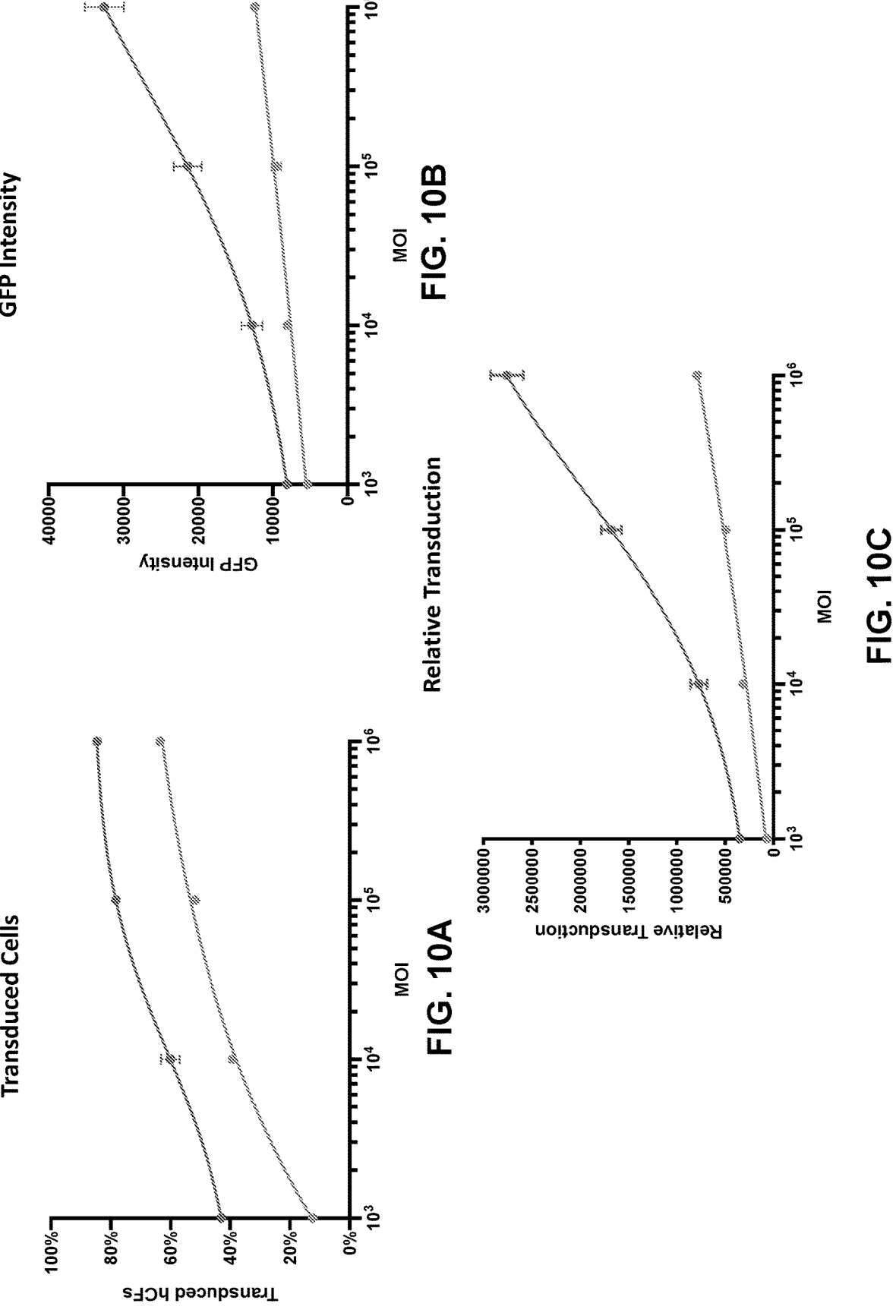

FIGS. 10A-10C show transduction of human cardiac fibroblasts (hCFs) with either AAV×1 vector (top lines) or AAV5 vector (bottom lines). FIG. 10A shows percentage of transduced cells. FIG. 10B shows GFP transgene expression. FIG. 10C shows relative transduction (Relative Transduction=Transduced Cells (%)×Cell Intensity).

Figure 11:

FIG. 11 shows relative transduction of cardiac fibroblast (CF) cell in vivo.

Figure 12:
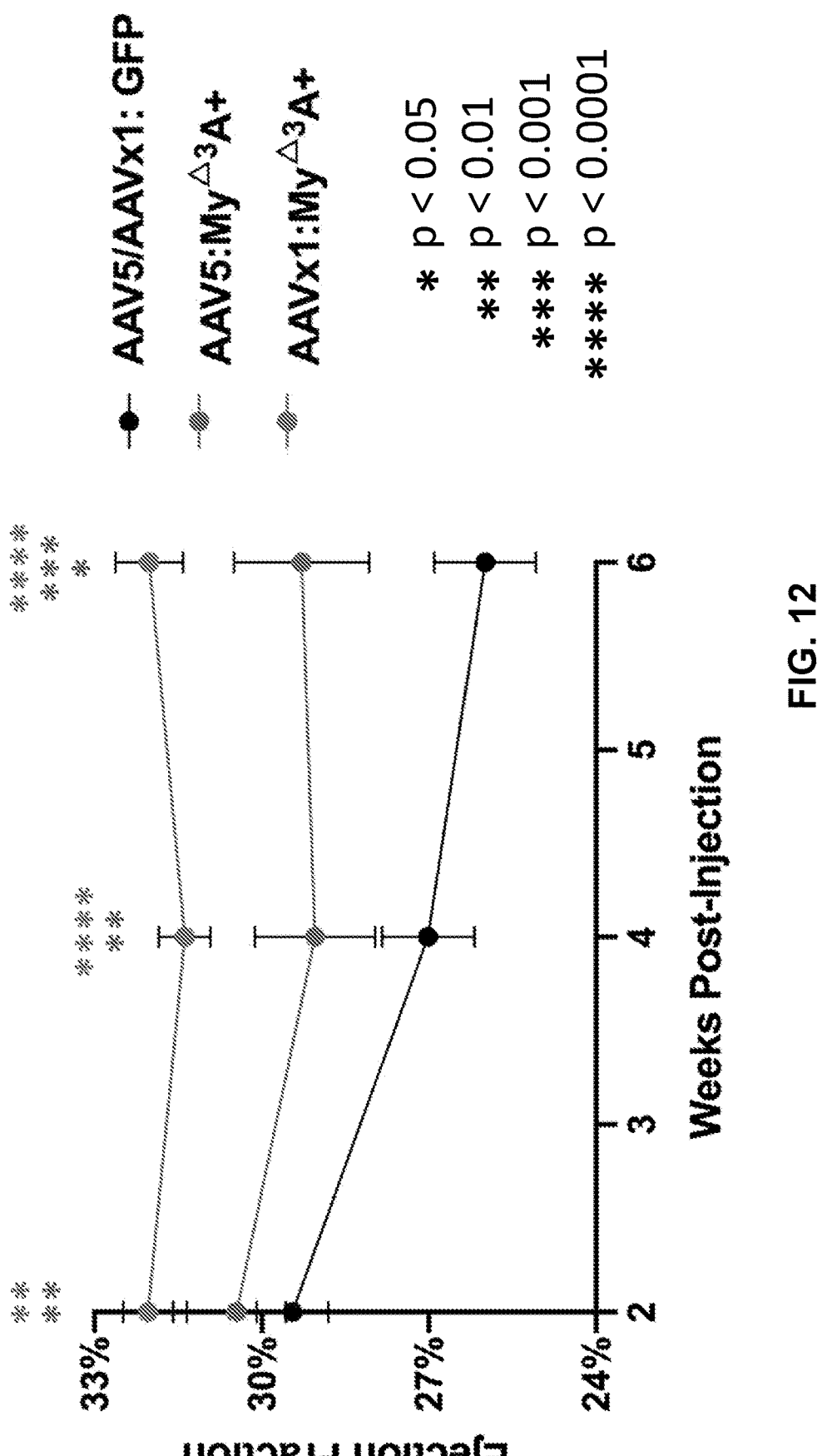

FIG. 12 shows AAV×1 vector with MyA expression cassette is efficacious against myocardial infarction by kinetic echocardiography data of % ejection fraction.

Figure 13:
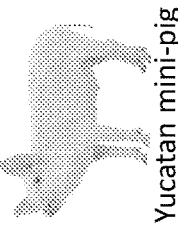

FIG. 13 shows a graph of the change in percent ejection fraction of treated and untreated pigs with ischemic injury, up to nine weeks post-injection.

DETAILED DESCRIPTION

The present disclosure relates generally to recombinant adeno-associated virus (rAAV) virions for use as viral vectors having capsid proteins with (1) substitutions at selected surface-exposed amino acid residues; (2) insertions in the GH loop; or (3) both. The rAAV virions may transduce cardiac tissues, e.g. cardiac fibroblasts, at least as well or better than rAAV virions having parental capsid proteins without these substitutions and/or insertions.

The disclosure provides recombinant adeno-associated virus (rAAV) virions. In particular, the disclosure provides new capsid proteins, methods of identifying them, and methods of using them. The methods of identifying new capsid proteins disclosed herein have wide applicability for any serotype of AAV, including hybrid capsid proteins. In addition, they can be applied to iteratively improve capsid proteins that have mutations from this or other methods. In general, the methods of the disclosure relate to preparation of randomized or semi-randomized libraries of AAV capsids in the form of cap gene polynucleotides, preparation of AAV virions comprising such capsids (either by incorporating the cap gene library into an AAV genome or providing it in trans such as on a plasmid transfected into the packaging line), positively or negatively selecting the AAV virions, and recovering the cap gene for sequencing. In some embodiments, the recovery and sequencing include nanopore sequencing. Other high-throughput or next-generation-sequencing (NGS) methods can be used.

In some embodiments, the rAAV virions disclosed herein comprise an AAV5 capsid protein, wherein the capsid protein comprises an insertion with respect to a parental sequence of 5 to 11 amino acids at an insertion site in the GH loop of the parental sequence. The rAAV virions generally comprise a heterologous nucleic acid comprising a nucleotide sequence encoding a gene product. Suitable insertion sites for the insertion can be determined by various methods, including but not limited to modeling the GH loop based on the crystal structure of the AAV5 capsid; by selecting flexible residues; or by screening various insertion sites. The insertion may be between two adjacent amino acids residues, or non-adjacent residues may be selected, in which case the insertion causes a deletion of one or more intervening residues.

In some embodiments, the AAV5 capsid protein comprises substitutions of residues that are either rationally designed; introduced by mutagenesis; or randomized through generating a library of sequences with random codon usage at one or more sites. Exemplary non-limiting substitutions that inflect transfection efficiency include, but are not limited to S651A, T578A or T582A. The substituted residues may be incorporated into AAV5 capsid proteins that further comprise insertions at one or more insertion sites, e.g. the GH loop or other loops.

The capsid proteins of the disclosure include any insertion identified as enriched by directed evolution followed by sequence, as shown in, but not limited to, the Examples. Without being limited to any particular insertion site, in some embodiments, the insertion is between about residues 574 and 575 in the AAV5 capsid protein (SEQ ID NO: 1). In some embodiments, the insertion site is between any two, optionally adjacent, amino acids at positions in the parental sequence corresponding to 560 to 594 of SEQ ID NO: 1. In some embodiments, the insertion site is between adjacent amino acids in the parental sequence corresponding to 574 and 575 of SEQ ID NO: 1. The N-terminal residue of VP1, VP2, and VP3 are indicated above the sequence of full-length VP1.

```
                                      (SEQ ID NO: 1)
VP1-->
MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

VP2-->
LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

VP3-->
NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV
```

-continued

```
↓ Insertion site 575
AYNVGGQMATNNQ_SSTTAPATGTYNLQEIVPGSVWMERDVYLQGPIWAKI

PETGAHFHPSPAMGGFGLKHPPPMMLIKNTPVPGNITSFSDVPVSSFITQY

STGQVTVEMEWELKKENSKRWNPEIQYTNNYNDPQFVDFAPDSTGEYRTTR

PIGTRYLTRPL
```

An insertion at this insertion site divides the VP3 capsid protein into an N-terminal segment (SEQ ID NO: 2) and a C-terminal segment (SEQ ID NO: 3), disclosed as distinct sequences herein for clarity, which may joined by any of the insertions of the disclosure. In some embodiments, the capsid protein comprises a sequence at least about 80%, 85%, 90%, 95%, 96%, 97%, 98%, 99%, 99.5%, or 100% identical to SEQ ID NO: 1 (for clarity, with a gap in the alignment at the insertion site). In some embodiments, the capsid protein comprises a sequence that shares at least about 80%, 85%, 90%, 95%, 96%, 97%, 98%, 99%, 99.5%, or 100% identity to SEQ ID NO: 2 and that shares at least about 80%, 85%, 90%, 95%, 96%, 97%, 98%, 99%, 99.5%, or 100% identity to SEQ ID NO: 3, where SEQ ID NO: 2 and SEQ ID NO: 3 are linked by an insertion of 5 to 11 amino acids. In some embodiments, the insertion is selected from SEQ ID NOs: 101-600. In some embodiments, the flanking alanine (A) residues of SEQ ID NOs: 101-600 are substituted with other residues, such as flexible residues serine (S) or glycine (G), the flanking A residues are absent.

```
                                      (SEQ ID NO: 2)
MGDRVVTKSTRTWVLPSYNNHQYREIKSGSVDGSNANAYFGYSTPWGYFDF

NRFHSHWSPRDWQRLINNYWGFRPRSLRVKIFNIQVKEVTVQDSTTTIANN

LTSTVQVFTDDDYQLPYVVGNGTEGCLPAFPPQVFTLPQYGYATLNRDNTE

NPTERSSFFCLEYFPSKMLRTGNNFEFTYNFEEVPFHSSFAPSQNLFKLAN

PLVDQYLYRFVSTNNTGGVQFNKNLAGRYANTYKNWFPGPMGRTQGWNLGS

GVNRASVSAFATTNRMELEGASYQVPPQPNGMTNNLQGSNTYALENTMIFN

SQPANPGTTATYLEGNMLITSESETQPVNRVAYNVGGQMATNNQ
                                      (SEQ ID NO: 3)
SSTTAPATGTYNLQEIVPGSVWMERDVYLQGPIWAKIPETGAHFHPSPAMG

GFGLKHPPPMMLIKNTPVPGNITSFSDVPVSSFITQYSTGQVTVEMEWELK

KENSKRWNPEIQYTNNYNDPQFVDFAPDSTGEYRTTRPIGTRYLTRPL
```

In some embodiments, the capsid protein comprising a sequence at least about 80%, 85%, 90%, 95%, 96%, 97%, 98%, 99%, 99.5%, or 100% identical to SEQ ID NO: 4, where X represents any amino acid. In some embodiments, the capsid protein comprising a sequence at least about 80%, 85%, 90%, 95%, 96%, 97%, 98%, 99%, 99.5%, or 100% identical to SEQ ID NO: 5, where X represents any amino acid.

```
                                      (SEQ ID NO: 4)
MGDRVVTKSTRTWVLPSYNNHQYREIKSGSVDGSNANAYFGYSTPWGYFDF

NRFHSHWSPRDWQRLINNYWGFRPRSLRVKIFNIQVKEVTVQDSTTTIANN

LTSTVQVFTDDDYQLPYVVGNGTEGCLPAFPPQVFTLPQYGYATLNRDNTE

NPTERSSFFCLEYFPSKMLRTGNNFEFTYNFEEVPFHSSFAPSQNLFKLAN

PLVDQYLYRFVSTNNTGGVQFNKNLAGRYANTYKNWFPGPMGRTQGWNLGS

GVNRASVSAFATTNRMELEGASYQVPPQPNGMTNNLQGSNTYALENTMIFN
```

-continued

SQPANPGTTATYLEGNMLITSESETQPVNRVAYNVGGQMATNNQXXXXXXX

XXSSTTAPATGTYNLQEIVPGSVWMERDVYLQGPIWAKIPETGAHFHPSPA

MGGFGLKHPPPMMLIKNTPVPGNITSFSDVPVSSFITQYSTGQVTVEMEWE

LKKENSKRWNPEIQYTNNYNDPQFVDFAPDSTGEYRTTRPIGTRYLTRPL (SEQ ID NO: 5)
MGDRVVTKSTRTWVLPSYNNHQYREIKSGSVDGSNANAYFGYSTPWGYFDF

NRFHSHWSPRDWQRLINNYWGFRPRSLRVKIFNIQVKEVTVQDSTTTIANN

LTSTVQVFTDDDYQLPYVVGNGTEGCLPAFPPQVFTLPQYGYATLNRDNTE

NPTERSSFFCLEYFPSKMLRTGNNFEFTYNFEEVPFHSSFAPSQNLFKLAN

PLVDQYLYRFVSTNNTGGVQFNKNLAGRYANTYKNWFPGPMGRTQGWNLGS

GVNRASVSAFATTNRMELEGASYQVPPQPNGMTNNLQGSNTYALENTMIFN

SQPANPGTTATYLEGNMLITSESETQPVNRVAYNVGGQMATNNQAXXXXXX

XASSTTAPATGTYNLQEIVPGSVWMERDVYLQGPIWAKIPETGAHFHPSPA

MGGFGLKHPPPMMLIKNTPVPGNITSFSDVPVSSFITQYSTGQVTVEMEWE

LKKENSKRWNPEIQYTNNYNDPQFVDFAPDSTGEYRTTRPIGTRYLTRPL

In some embodiments, the insertion is a peptide of formula $$-X_0\text{-}(X)_n\text{-}X_{10}\text{-}$$

wherein n is 5-9, and wherein $X_0$ and $X_{10}$ are each independently A, S, G, or absent (SEQ ID NO: 1101).

In some embodiments, the insertion is a peptide of formula:

$$-X_0\text{-}X_1\text{-}X_2\text{-}X_3\text{-}X_4\text{-}X_5\text{-}X_6\text{-}X_7\text{-}X_8\text{-}$$

wherein $X_0$ and $X_8$ are each independently A, S, G, or absent (SEQ ID NO: 1102).

In some embodiments, the insertion is a peptide of formula:

$$-A\text{-}X_1\text{-}X_2\text{-}X_3\text{-}X_4\text{-}X_5\text{-}X_6\text{-}X_7\text{-}A\text{-}$$

wherein $X_1$ is P, R, or G; $X_2$ is K, L, or R; $X_3$ is any amino acid; $X_4$ is N, H, K, or Q; $X_5$ is any amino acid, or optionally $X_5$ is G, K, or S; $X_6$ is any amino acid, or optionally $X_6$ is T or V; and $X_7$ is any amino acid, or optionally $X_7$ is K or V (SEQ ID NO: 1103).

In some embodiments, the insertion is a peptide of formula:

$$-A\text{-}X_1\text{-}X_2\text{-}X_3\text{-}X_4\text{-}X_5\text{-}X_6\text{-}X_7\text{-}A\text{-}$$

wherein $X_1$ is P, R, or G; $X_2$ is K, L, or R; $X_3$ is any amino acid; $X_4$ is N, H, K, or Q; $X_5$ is any amino acid, or optionally $X_5$ is G, K, or S; $X_6$ is any amino acid; and $X_7$ is any amino acid (SEQ ID NO: 1104).

In some embodiments, the insertion is a peptide of formula:

$$-A\text{-}X_1\text{-}X_2\text{-}X_3\text{-}X_4\text{-}X_5\text{-}X_6\text{-}X_7\text{-}A\text{-}$$

wherein $X_1$ is P, R, or G; $X_2$ is K, L, or R; $X_3$ is any amino acid; $X_4$ is N, H, K, or Q; $X_5$ is any amino acid, or optionally $X_5$ is G, K, or S; $X_6$ is T or V; and $X_7$ is any amino acid (SEQ ID NO: 1105).

In some embodiments, the insertion is a peptide of formula:

$$-A\text{-}X_1\text{-}X_2\text{-}X_3\text{-}X_4\text{-}X_5\text{-}X_6\text{-}X_7\text{-}A\text{-}$$

wherein $X_1$ is P, R, or G; $X_2$ is K, L, or R; $X_3$ is any amino acid; $X_4$ is N, H, K, or Q; $X_5$ is any amino acid, or optionally $X_5$ is G, K, or S; $X_6$ is T or V; and $X_7$ is K or V (SEQ ID NO: 1106).

In some embodiments, $X_1$ through $X_7$ are any amino acid, wherein the insertion is defined by one or more of the following criteria: $X_1$ is P, R, or G; $X_2$ is K, L, or R; $X_3$ is any amino acid; $X_4$ is N, H, K, or Q; $X_5$ is $X_5$ is G, K, or S; $X_6$ is T or V; and/or $X_7$ is $X_7$ is K or V (SEQ ID NO: 1107).

In some embodiments, the insertion is selected from SEQ ID NOs: 101-600.

In some embodiments, the capsid protein comprises, in N-terminal to C-terminal order, one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 3; one polypeptide selected from SEQ ID NOs 101-600; and one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 2.

In some embodiments, the capsid protein comprises, in N-terminal to C-terminal order, one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 3; one polypeptide selected from SEQ ID NOs: 101-200; and one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 2.

In some embodiments, the capsid protein comprises, in N-terminal to C-terminal order, one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 3; one polypeptide selected from SEQ ID NOs: 101-150; and one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 2.

In some embodiments, the capsid protein comprises, in N-terminal to C-terminal order, one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 3; one polypeptide selected from SEQ ID NOs: 101-120; and one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 2.

In some embodiments, the capsid protein comprises, in N-terminal to C-terminal order, one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 3; one polypeptide selected from SEQ ID NOs: 101-115; and one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 2.

In some embodiments, the capsid protein comprises, in N-terminal to C-terminal order, one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 3; one polypeptide selected from SEQ ID NOs: 103 or 110; and one polypeptide having sequence at least about 80%, 85%, 90%, 95%, 96%, 97%, 98%, 99%, 99.5%, or 100% identical to SEQ ID NO: 2 and at least about 80%, 85%, 90%, 95%, 96%, 97%, 98%, 99%, 99.5%, or 100% identical to SEQ ID NO: 2.

In some embodiments, the capsid protein comprises, consists essentially of, or consists of a polypeptide having sequence at least about 80%, 85%, 90%, 95%, 96%, 97%, 98%, 99%, 99.5%, or 100% identical to one of SEQ ID NOs 601-1100, or a functional fragment thereof.

In some embodiments, the capsid protein comprises, consists essentially of, or consists of a polypeptide having sequence at least about 80%, 85%, 90%, 95%, 96%, 97%, 98%, 99%, 99.5%, or 100% identical to one of SEQ ID NOs 601-615, or a functional fragment thereof.

In some embodiments, the insertion comprises an amino acid sequence selected from RKVHIEV (SEQ ID NO: 81), RKYQSDL (SEQ ID NO: 82), PLTNTVK (SEQ ID NO: 83), LKYHGPP (SEQ ID NO: 84), RKYQGDM (SEQ ID NO: 85), RKFHSTD (SEQ ID NO: 86), RKHHGLE (SEQ ID NO: 87), PGTNVTK (SEQ ID NO: 88), RKMHMPD (SEQ ID NO: 89), PLKKIVQ (SEQ ID NO: 90), PLGKKTS (SEQ ID NO: 91), PRGVKVT (SEQ ID NO: 92), PLAKSKS (SEQ ID NO: 93), PRTKGAV (SEQ ID NO: 94), and PSGRKAT (SEQ ID NO: 95).

In some embodiments, the insertion comprises an amino acid sequence selected from ARKVHIEVA (SEQ ID NO: 101), ARKYQSDLA (SEQ ID NO: 102), APLTNTVKA (SEQ ID NO: 103), ALKYHGPPA (SEQ ID NO: 104), ARKYQGDMA (SEQ ID NO: 105), ARKFHSTDA (SEQ ID NO: 106), ARKHHGLEA (SEQ ID NO: 107), APGTNVTKA (SEQ ID NO: 108), ARKMHMPDA (SEQ ID NO: 109), APLKKIVQA (SEQ ID NO: 110), APLGKKTSA (SEQ ID NO: 111), APRGVKVTA (SEQ ID NO: 112), APLAKSKSA (SEQ ID NO: 113), APRTKGAVA (SEQ ID NO: 114), APSGRKATA (SEQ ID NO: 115).

In some embodiments, the insertion comprises any one of SEQ ID NOs: 101-600. In some embodiments, a sequence comprising at most 1, 2, 3, or 4 amino-acid substitutions relative to any one of SEQ ID NOs: 101-600.

In some embodiments, the insertion comprises the amino acid sequence PLTNTVK (SEQ ID NO: 83) (clone CR17) or a sequence comprising at most 1, 2, 3, or 4 amino-acid substitutions relative to PLTNTVK (SEQ ID NO: 83).

In some embodiments, the insertion comprises the amino acid sequence PLKKIVQ (SEQ ID NO: 90) (clone CR23) or a sequence comprising at most 1, 2, 3, or 4 amino-acid substitutions relative to PLKKIVQ (SEQ ID NO: 90).

In some embodiments, the the insertion comprises the amino acid sequence APLTNTVKA (SEQ ID NO: 103) (clone CR17) or a sequence comprising at most 1, 2, 3, or 4 amino-acid substitutions relative to APLTNTVKA (SEQ ID NO: 103).

In some embodiments, the the insertion comprises the amino acid sequence APLKKIVQA (SEQ ID NO: 110) (clone CR23), wherein the insertion further comprises 1, 2, 3, or 4 conservative amino-acid substitutions.

In some embodiments, the insertion comprises the amino acid sequence PLTNTVK (SEQ ID NO: 83) (clone CR17), wherein the insertion further comprises 1, 2, 3, or 4 conservative amino-acid substitutions.

In some embodiments, the insertion comprises the amino acid sequence PLKKIVQ (SEQ ID NO: 90) (clone CR23), wherein the insertion further comprises 1, 2, 3, or 4 conservative amino-acid substitutions.

In some embodiments, the the insertion comprises the amino acid sequence APLTNTVKA (SEQ ID NO: 103) (clone CR17), wherein the insertion further comprises 1, 2, 3, or 4 conservative amino-acid substitutions.

In some embodiments, the the insertion comprises the amino acid sequence at least APLKKIVQA (SEQ ID NO: 110) (clone CR23), wherein the insertion further comprises 1, 2, 3, or 4 conservative amino-acid substitutions.

Conservative substitutions include polar for polar residues, non-polar for non-polar residues, hydrophobic for hydrophobic resides, small for small residues, and large for large residues. Conservative substitutions further comprise substitutions within the following groups: {S, T}, {A, G}, {F, Y}, {R, H, K, N, E}, {S, T, N, Q}, {C, U, G, P; A}, and {A, V, I, L, M, F, Y, W}.

Transduction efficiently can be determined using methods known in the art or those described in the Examples. In some embodiments, the rAAV virion exhibits increased transduction efficiency in cardiac cells compared to an AAV virion comprising the parental sequence.

In some embodiments, the rAAV virion exhibits increased transduction efficiency in human cardiac fibroblast (hCF) cells compared to an AAV virion comprising the parental sequence.

In some embodiments, the rAAV virion exhibits at least 2-, 3-, 4-, 5-, 6, 7-, 8-, 9-, 10, 11-, 12-, 13-, 14, or 15-fold increased transduction efficiency in hCF cells at a multiplicity of infection (MOI) of 100,000. In some embodiments, the rAAV virion exhibits about 2- to about 16-fold, about 2- to about 14-fold, about 2- to about 12-fold, about 2- to about 10-fold, about 2- to about 8-fold, about 2- to about 6-fold, about 2- to about 4-fold, or about 2- to about 3-fold increased transduction efficiency in hCF cells at a multiplicity of infection (MOI) of 100,000. In some embodiments, the rAAV virion exhibits at least 2-, 3-, 4-, 5-, 6, 7-, 8-, 9-, 10, 11-, 12-, 13-, 14, or 15-fold increased transduction efficiency in hCF cells at a multiplicity of infection (MOI) of 100,000. In some embodiments, the rAAV virion exhibits about 20% to 30%, about 30% to 40%, about 40% to 50%, about 50% to 80%, about 80% to 100%, about 100% to 125%, about 125% to 150%, about 150% to 175%, or about 175% to 200% increased transduction efficiency in hCF cells at a multiplicity of infection (MOI) of 100,000.

In some embodiments, the rAAV virion exhibits at least 2-, 3-, 4-, 5-, 6, 7-, 8-, 9-, 10, 11-, 12-, 13-, 14, or 15-fold increased transduction efficiency in hCF cells at a multiplicity of infection (MOI) of 1,000. In some embodiments, the rAAV virion exhibits about 2- to about 16-fold, about 2- to about 14-fold, about 2- to about 12-fold, about 2- to about 10-fold, about 2- to about 8-fold, about 2- to about 6-fold, about 2- to about 4-fold, or about 2- to about 3-fold increased transduction efficiency in hCF cells at a multiplicity of infection (MOI) of 1,000. In some embodiments, the rAAV virion exhibits about 20% to 30%, about 30% to 40%, about 40% to 50%, about 50% to 80%, about 80% to 100%, about 100% to 125%, about 125% to 150%, about 150% to 175%, or about 175% to 200% increased transduction efficiency in hCF cells at a multiplicity of infection (MOI) of 1,000.

In some embodiments, the rAAV virion exhibits increased transduction efficiency in induced pluripotent stem cell-derived cardiomyocyte (iPS-CM) cells compared to an AAV virion comprising the parental sequence.

In some embodiments, the rAAV virion exhibits at least 2-, 3-, 4-, 5-, 6, 7-, 8-, 9-, 10, 11-, 12-, 13-, 14, or 15-fold increased transduction efficiency in iPS-CM cells at a multiplicity of infection (MOI) of 100,000. In some embodiments, the rAAV virion exhibits about 2- to about 16-fold, about 2- to about 14-fold, about 2- to about 12-fold, about 2- to about 10-fold, about 2- to about 8-fold, about 2- to about 6-fold, about 2- to about 4-fold, or about 2- to about 3-fold increased transduction efficiency in iPS-CM cells at a multiplicity of infection (MOI) of 100,000. In some embodiments, the rAAV virion exhibits about 20% to 30%, about 30% to 40%, about 40% to 50%, about 50% to 80%, about 80% to 100%, about 100% to 125%, about 125% to 150%, about 150% to 175%, or about 175% to 200% increased transduction efficiency in iPS-CM cells at a multiplicity of infection (MOI) of 100,000.

In some embodiments, the rAAV virion exhibits at least 2-, 3-, 4-, 5-, 6, 7-, 8-, 9-, 10, 11-, 12-, 13-, 14, or 15-fold increased transduction efficiency in iPS-CM cells at a multiplicity of infection (MOI) of 1,000. In some embodiments, the rAAV virion exhibits about 2- to about 16-fold, about 2- to about 14-fold, about 2- to about 12-fold, about 2- to about 10-fold, about 2- to about 8-fold, about 2- to about 6-fold, about 2- to about 4-fold, or about 2- to about 3-fold increased transduction efficiency in iPS-CM cells at a multiplicity of infection (MOI) of 1,000. In some embodiments, the rAAV virion exhibits about 20% to 30%, about 30% to 40%, about 40% to 50%, about 50% to 80%, about 80% to 100%, about 100% to 125%, about 125% to 150%, about 150% to 175%, or about 175% to 200% increased transduction efficiency in iPS-CM cells at a multiplicity of infection (MOI) of 1,000.

Selectivity for a cell type is increased when the ratio of the transduction efficiencies for one cell type over another is increased by the capsid protein compared to a parental sequence. In some embodiments, the rAAV virion exhibits increased selectivity of the rAAV virion for hCF cells over iPS-CM cells.

In some embodiments, the rAAV virion exhibits increased selectivity of the rAAV virion for iPS-CM cells over hCF cells.

In some embodiments, the capsid protein comprises a mutation selected from S651A, T578A, T582A, K251R, Y709F, Y693F, or S485A. In some embodiments, the capsid protein comprises a mutation selected from K251R, Y709F, Y693F, or S485A.

The polynucleotide encoding the capsid protein can comprise a sequence comprising either the native codons of the wild-type cap gene, or alternative codons selected to encode the same protein. The codon usage of the insertion can be varied. Representative nucleotide sequences for cap genes encoding capsid proteins of the disclosure are provided as SEQ ID NOs 51-72. In some embodiments, the disclosure provides a polynucleotide encoding an AAV5 capsid protein comprising a sequence at least 95%, 99%, or 100% identical to one of SEQ ID NOs 51-72. It is within the skill of those in the art to select appropriate nucleotide sequences and to derive alternative nucleotide sequences to encode any capsid protein of the disclosure. Reverse translation of the protein sequence can be performed using the codon usage table of the host organism, i.e. Eukaryotic codon usage for humans.

In some embodiments, the disclosure provides a polynucleotide encoding an AAV5 capsid protein comprising a sequence at least 95%, 99%, or 100% identical to SEQ ID NO: 51 {CR2 polynucleotide sequence}, wherein the AAV5 capsid protein comprises SEQ ID NO: 101 or a sequence comprising at most 1, 2, 3, or 4 amino-acid substitutions relative to ARKVHIEVA (SEQ ID NO: 101).

In some embodiments, the disclosure provides a polynucleotide encoding an AAV5 capsid protein comprising a sequence at least 95%, 99%, or 100% identical to SEQ ID NO: 52 {CR5 polynucleotide sequence}, wherein the AAV5 capsid protein comprises SEQ ID NO: 102 or a sequence comprising at most 1, 2, 3, or 4 amino-acid substitutions relative to ARKYQSDLA (SEQ ID NO: 102).

In some embodiments, the disclosure provides a polynucleotide encoding an AAV5 capsid protein comprising a sequence at least 95%, 99%, or 100% identical to SEQ ID NO: 53 {CR8 polynucleotide sequence}, wherein the AAV5 capsid protein comprises SEQ ID NO: 107 or a sequence comprising at most 1, 2, 3, or 4 amino-acid substitutions relative to ARKHHGLEA (SEQ ID NO: 107).

In some embodiments, the disclosure provides a polynucleotide encoding an AAV5 capsid protein comprising a sequence at least 95%, 99%, or 100% identical to SEQ ID NO: 54 {CR17 polynucleotide sequence}, wherein the AAV5 capsid protein comprises SEQ ID NO: 103 or a sequence comprising at most 1, 2, 3, or 4 amino-acid substitutions relative to APLTNTVKA (SEQ ID NO: 103).

In some embodiments, the disclosure provides a polynucleotide encoding an AAV5 capsid protein comprising a sequence at least 95%, 99%, or 100% identical to SEQ ID NO: 55 {CR18 polynucleotide sequence}, wherein the AAV5 capsid protein comprises SEQ ID NO: 104 or a sequence comprising at most 1, 2, 3, or 4 amino-acid substitutions relative to ALKYHGPPA (SEQ ID NO: 104).

In some embodiments, the disclosure provides a polynucleotide encoding an AAV5 capsid protein comprising a sequence at least 95%, 99%, or 100% identical to SEQ ID NO: 56 {CR19 polynucleotide sequence}, wherein the AAV5 capsid protein comprises SEQ ID NO: 105 or a sequence comprising at most 1, 2, 3, or 4 amino-acid substitutions relative to ARKYQGDMA (SEQ ID NO: 105).

In some embodiments, the disclosure provides a polynucleotide encoding an AAV5 capsid protein comprising a sequence at least 95%, 99%, or 100% identical to SEQ ID NO: 57 {CR20 polynucleotide sequence}, wherein the AAV5 capsid protein comprises SEQ ID NO: 106 or a sequence comprising at most 1, 2, 3, or 4 amino-acid substitutions relative to ARKFHSTDA (SEQ ID NO: 106).

In some embodiments, the disclosure provides a polynucleotide encoding an AAV5 capsid protein comprising a sequence at least 95%, 99%, or 100% identical to SEQ ID NO: 58 {CR21 polynucleotide sequence}, wherein the AAV5 capsid protein comprises SEQ ID NO: 108 or a sequence comprising at most 1, 2, 3, or 4 amino-acid substitutions relative to APGTNVTKA (SEQ ID NO: 108).

In some embodiments, the disclosure provides a polynucleotide encoding an AAV5 capsid protein comprising a sequence at least 95%, 99%, or 100% identical to SEQ ID NO: 59 {CR22 polynucleotide sequence}, wherein the AAV5 capsid protein comprises SEQ ID NO: 109 or a sequence comprising at most 1, 2, 3, or 4 amino-acid substitutions relative to ARKMHMPDA (SEQ ID NO: 109).

In some embodiments, the disclosure provides a polynucleotide encoding an AAV5 capsid protein comprising a sequence at least 95%, 99%, or 100% identical to SEQ ID NO: 60 {CR23 polynucleotide sequence}, wherein the AAV5 capsid protein comprises SEQ ID NO: 110 or a sequence comprising at most 1, 2, 3, or 4 amino-acid substitutions relative to APLKKIVQA (SEQ ID NO: 110).

In some embodiments, the disclosure provides a polynucleotide encoding an AAV5 capsid protein comprising a sequence at least 95%, 99%, or 100% identical to SEQ ID NO: 61 {CR24 polynucleotide sequence}, wherein the AAV5 capsid protein comprises SEQ ID NO: 111 or a sequence comprising at most 1, 2, 3, or 4 amino-acid substitutions relative to APLGKKTSA (SEQ ID NO: 111).

In some embodiments, the disclosure provides a polynucleotide encoding an AAV5 capsid protein comprising a sequence at least 95%, 99%, or 100% identical to SEQ ID NO: 62 {CR25 polynucleotide sequence}, wherein the AAV5 capsid protein comprises SEQ ID NO: 112 or a sequence comprising at most 1, 2, 3, or 4 amino-acid substitutions relative to APRGVKVTA (SEQ ID NO: 112).

In some embodiments, the disclosure provides a polynucleotide encoding an AAV5 capsid protein comprising a sequence at least 95%, 99%, or 100% identical to SEQ ID NO: 63 {CR26 polynucleotide sequence}, wherein the AAV5 capsid protein comprises SEQ ID NO: 113 or a sequence comprising at most 1, 2, 3, or 4 amino-acid substitutions relative to APLAKSKSA (SEQ ID NO: 113).

In some embodiments, the disclosure provides a polynucleotide encoding an AAV5 capsid protein comprising a sequence at least 95%, 99%, or 100% identical to SEQ ID NO: 64 {CR27 polynucleotide sequence}, wherein the AAV5 capsid protein comprises SEQ ID NO: 114 or a sequence comprising at most 1, 2, 3, or 4 amino-acid substitutions relative to APRTKGAVA (SEQ ID NO: 114).

In some embodiments, the disclosure provides a polynucleotide encoding an AAV5 capsid protein comprising a sequence at least 95%, 99%, or 100% identical to SEQ ID NO: 65 {CR28 polynucleotide sequence}, wherein the AAV5 capsid protein comprises SEQ ID NO: 115 or a sequence comprising at most 1, 2, 3, or 4 amino-acid substitutions relative to APSGRKATA (SEQ ID NO: 115).

In some embodiments, the disclosure provides a polynucleotide encoding an AAV5 capsid protein comprising a sequence at least 95%, 99%, or 100% identical to SEQ ID NO: 66, wherein the AAV5 capsid protein comprises the substitution K251R with respect to SEQ ID NO: 1.

In some embodiments, the disclosure provides a polynucleotide encoding an AAV5 capsid protein comprising a sequence at least 95%, 99%, or 100% identical to SEQ ID NO: 67, wherein the AAV5 capsid protein comprises the substitution S485A with respect to SEQ ID NO: 1.

In some embodiments, the disclosure provides a polynucleotide encoding an AAV5 capsid protein comprising a sequence at least 95%, 99%, or 100% identical to SEQ ID NO: 68, wherein the AAV5 capsid protein comprises the substitution S651A with respect to SEQ ID NO: 1.

In some embodiments, the disclosure provides a polynucleotide encoding an AAV5 capsid protein comprising a sequence at least 95%, 99%, or 100% identical to SEQ ID NO: 69, wherein the AAV5 capsid protein comprises the substitution T578A with respect to SEQ ID NO: 1.

In some embodiments, the disclosure provides a polynucleotide encoding an AAV5 capsid protein comprising a sequence at least 95%, 99%, or 100% identical to SEQ ID NO: 70, wherein the AAV5 capsid protein comprises the substitution T582A with respect to SEQ ID NO: 1.

In some embodiments, the disclosure provides a polynucleotide encoding an AAV5 capsid protein comprising a sequence at least 95%, 99%, or 100% identical to SEQ ID NO: 71, wherein the AAV5 capsid protein comprises the substitution Y709F with respect to SEQ ID NO: 1.

In some embodiments, the disclosure provides a polynucleotide encoding an AAV5 capsid protein comprising a sequence at least 95%, 99%, or 100% identical to SEQ ID NO: 72, wherein the AAV5 capsid protein comprises the substitution Y693F with respect to SEQ ID NO: 1.

In some embodiments, the disclosure provides an AAV5 capsid protein comprising a sequence at least 95%, 99%, or 100% identical to a modified capsid selected from SEQ ID NOs: 9-34, wherein the substitutions in the modified capsid from the reference capsid SEQ ID NO: 1 are present, and wherein other substitutions, optionally conservative substitutions, with the specified percent identity level are tolerated.

In some embodiment, the insertion site is between any two, optionally adjacent, amino acids at positions in the parental sequence corresponding to 420 to 460 of SEQ ID NO: 1. In some embodiments, the insertion site is between adjacent amino acids in the parental sequence corresponding to 444 and 445 of SEQ ID NO: 1. An exemplary embodiment is the AAV5 capsid disclosure as SEQ ID NO: 31.

In some embodiments, the recombinant adeno-associated virus (rAAV) virion disclosed herein comprise an AAV5 capsid protein, wherein the capsid protein comprises one or more substitutions selected from S651G, S651V, S651L, S651I, T578A, T578G, T578V, T578L, T578I, T582A, T582G, T582V, T582L, or T582I compared to a parental AAV5 capsid; and a heterologous nucleic acid comprising a nucleotide sequence encoding a gene product.

In some embodiments, the recombinant adeno-associated virus (rAAV) virion disclosed herein comprise an AAV5 capsid protein, wherein the capsid protein comprises one or more substitutions selected from S651A, T578A, or T582A compared to a parental AAV5 capsid; and a heterologous nucleic acid comprising a nucleotide sequence encoding a gene product.

The AAV5 capsid protein may comprise any two substitutions selected from S651A or S651V; T578A or T578V; or T582A or T582V—or all three of S651A or S651V; T578A or T578V; or T582A or T582V. The following combinations of mutations are expressly contemplated by the present disclosure:

a) T578G+S651G;
    b) T578V+S651V;
    c) T578L+S651L;
    d) T578I+S651I;
    e) T582A+S651A;
    f) T582G+S651G;
    g) T582V+S651V;
    h) T582L+S651L;
    i) T582I+S651I;
    j) T578A+T582A+S651A;
    k) T578G+T582G+S651G;
    l) T578V+T582V+S651V;
    m) T578L+T582L+S651L; and
    n) T578I+T582I+S651I.

The AAV5 capsid protein may comprise any two substitutions selected from S651A, T578A, or T582A; or all three S651A, T578A, or T582A. For example, the AAV5 capsid protein may be any one of SEQ ID NOs 74-80, or a sequence at least 90%, 92%, 95%, 96%, 97%, 98%, 99%, or 100% identical thereto.

```
T578A, T582A, and/or S651A
                                   (SEQ ID NO: 73)
MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK
```

-continued

ARTEEDSKPSTSSDAEAGPSGSQQLQIPAQPASSLGADTMSAGGGGPLGDN

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

AYNVGGQMATNNQSSTXAPAXGTYNLQEIVPGSVWMERDVYLQGPIWAKIP

ETGAHFHPSPAMGGFGLKHPPPMMLIKNTPVPGNITSFXDVPVSSFITQYS

TGQVTVEMEWELKKENSKRWNPEIQYTNNYNDPQFVDFAPDSTGEYRTTRP

IGTRYLTRPL, where X = A, G, V, S, or T

T578A (SEQ ID NO: 74)

MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

AYNVGGQMATNNQSSTAAPATGTYNLQEIVPGSVWMERDVYLQGPIWAKIP

ETGAHFHPSPAMGGFGLKHPPPMMLIKNTPVPGNITSFSDVPVSSFITQYS

TGQVTVEMEWELKKENSKRWNPEIQYTNNYNDPQFVDFAPDSTGEYRTTRP

IGTRYLTRPL

T582A (SEQ ID NO: 75)

MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

-continued

AYNVGGQMATNNQSSTTAPAAGTYNLQEIVPGSVWMERDVYLQGPIWAKIP

ETGAHFHPSPAMGGFGLKHPPPMMLIKNTPVPGNITSFSDVPVSSFITQYS

TGQVTVEMEWELKKENSKRWNPEIQYTNNYNDPQFVDFAPDSTGEYRTTRP

IGTRYLTRPL

S651A (SEQ ID NO: 76)

MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

AYNVGGQMATNNQSSTTAPATGTYNLQEIVPGSVWMERDVYLQGPIWAKIP

ETGAHFHPSPAMGGFGLKHPPPMMLIKNTPVPGNITSFADVPVSSFITQYS

TGQVTVEMEWELKKENSKRWNPEIQYTNNYNDPQFVDFAPDSTGEYRTTRP

IGTRYLTRPL

T578A and T582A (SEQ ID NO: 77)

MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

AYNVGGQMATNNQSSTAAPAAGTYNLQEIVPGSVWMERDVYLQGPIWAKIP

ETGAHFHPSPAMGGFGLKHPPPMMLIKNTPVPGNITSFSDVPVSSFITQYS

TGQVTVEMEWELKKENSKRWNPEIQYTNNYNDPQFVDFAPDSTGEYRTTRP

IGTRYLTRPL

T578A and S651A (SEQ ID NO: 78)

MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

-continued

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

AYNVGGQMATNNQSSTAAPATGTYNLQEIVPGSVWMERDVYLQGPIWAKIP

ETGAHFHPSPAMGGFGLKHPPPMMLIKNTPVPGNITSFADVPVSSFITQYS

TGQVTVEMEWELKKENSKRWNPEIQYTNNYNDPQFVDFAPDSTGEYRTTRP

IGTRYLTRPL

T582A and S651A (SEQ ID NO: 79)

MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

AYNVGGQMATNNQSSTTAPAAGTYNLQEIVPGSVWMERDVYLQGPIWAKIP

ETGAHFHPSPAMGGFGLKHPPPMMLIKNTPVPGNITSFADVPVSSFITQYS

TGQVTVEMEWELKKENSKRWNPEIQYTNNYNDPQFVDFAPDSTGEYRTTRP

IGTRYLTRPL

T578A, T582A, and S651A (SEQ ID NO: 80)

MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

AYNVGGQMATNNQSSTAAPAAGTYNLQEIVPGSVWMERDVYLQGPIWAKIP

-continued

ETGAHFHPSPAMGGFGLKHPPPMMLIKNTPVPGNITSFADVPVSSFITQYS

TGQVTVEMEWELKKENSKRWNPEIQYTNNYNDPQFVDFAPDSTGEYRTTRP

IGTRYLTRPL

In any of the foregoing sequences, the alanine substitution may instead be a substitutions to a valine (V), glycine (G), leucine (L), or isoleucine (I).

In some embodiments, one or more amino acid residues are conserved to the residue present in wild-type AAV5 capsid. For example, in some embodiments, T581 is conserved as a tyrosine (T), or semi-conserved as serine (S). By contrast, U.S. Pat. No. 10,046,016 teaches that infectivity of lung epithelial cells is increased by mutation by a T581A mutation.

Definitions

Unless the context indicates otherwise, the features of the invention can be used in any combination. Any feature or combination of features set forth can be excluded or omitted. Certain features of the invention, which are described in separate embodiments may also be provided in combination in a single embodiment. Features of the invention, which are described in a single embodiment may also be provided separately or in any suitable sub-combination. All combinations of the embodiments are disclosed herein as if each and every combination were individually disclosed. All sub-combinations of the embodiments and elements are disclosed herein as if every such sub-combination were individually disclosed.

Unless defined otherwise, all technical and scientific terms used herein have the same meaning as commonly understood by one of ordinary skill in the art to which this invention belongs. The detailed description is divided into sections only for the reader's convenience and disclosure found in any section may be combined with that in another section. Although any methods and materials similar or equivalent to those described herein can also be used in the practice or testing of the present invention, the exemplary methods and materials are now described. All publications mentioned herein are incorporated by reference to disclose and describe the methods and/or materials in connection with which the publications are cited. Reference to a publication is not an admission that the publication is prior art.

The singular forms "a," "an," and "the" include plural referents unless the context clearly dictates otherwise. For example, reference to "a recombinant AAV virion" includes a plurality of such virions and reference to "the cardiac cell" includes one or more cardiac cells.

The conjunction "and/or" means both "and" and "or," and lists joined by "and/or" encompasses all possible combinations of one or more of the listed items.

The term "vector" refers to a macromolecule or complex of molecules comprising a polynucleotide or protein to be delivered to a cell.

"AAV" is an abbreviation for adeno-associated virus. The term covers all subtypes of AAV, except where a subtype is indicated, and to both naturally occurring and recombinant forms. The abbreviation "rAAV" refers to recombinant adeno-associated virus. "AAV" includes AAV or any subtype. "AAV5" refers to AAV subtype 5. The genomic sequences of various serotypes of AAV, as well as the sequences of the native inverted terminal repeats (ITRs), Rep proteins, and capsid subunits may be found in the literature or in public databases such as GenBank. See. e.g., GenBank Accession Numbers NC_002077 (AAV1), AF063497 (AAV1), NC_001401 (AAV2), AF043303 (AAV2), NC_001729 (AAV3), NC_001829 (AAV4), U89790 (AAV4), NC_006152 (AAV5), AF513851 (AAV7), AF513852(AAV8), and NC_006261 (AAV8). Publications describing AAV include Srivistava et al. (1983) *J. Virol.* 45:555; Chiorini et al. (1998) *J. Virol.* 71:6823; Chiorini et al. (1999) *J. Virol.* 73:1309; Bantel-Schaal et al. (1999) *J. Virol.* 73:939; Xiao et al. (1999) *J. Virol.* 73:3994; Muramatsu et al. (1996) *Virol.* 221:208; Shade et al. (1986) *J. Virol.* 58:921; Gao et al. (2002) *Proc. Nat. Acad. Sci. USA* 99: 11854; Moris et al. (2004) *Virology* 33:375-383; Int'l Pat. Publ Nos. WO2018/222503A1, WO2012/145601A2, WO2000/028061A2, WO1999/61601A2, and WO1998/11244A2; U.S. patent application Ser. Nos. 15/782,980 and 15/433,322; and U.S. Pat. Nos. 10,036,016, 9,790,472, 9,737,618, 9,434,928, 9,233,131, 8,906,675, 7,790,449, 7,906,111, 7,718,424, 7,259,151, 7,198,951, 7,105,345, 6,962,815, 6,984,517, and 6,156,303.

An "AAV vector" or "rAAV vector" as used in the art to refer either to the DNA packaged into in the rAAV virion or to the rAAV virion itself, depending on context. As used herein, unless otherwise apparent from context, rAAV vector refers to a nucleic acid (typically a plasmid) comprising a polynucleotide sequence capable of being packaged into an rAAV virion, but with the capsid or other proteins of the rAAV virion. Generally an rAAV vector comprises a heterologous polynucleotide sequence (i.e., a polynucleotide not of AAV origin) and one or two AAV inverted terminal repeat sequences (ITRs) flanking the heterologous polynucleotide sequence. Only one of the two ITRs may be packaged into the rAAV and yet infectivity of the resulting rAAV virion may be maintained. See Wu et al. (2010) *Mol Ther.* 18:80. An rAAV vector may be designed to generate either single-stranded (ssAAV) or self-complementary (scAAV). See McCarty D. (2008) *Mo. Ther.* 16:1648-1656; WO2001/11034; WO2001/92551; WO2010/129021.

An "rAAV virion" refers to an extracellular viral particle including at least one viral capsid protein (e.g. VP1) and an encapsidated rAAV vector (or fragment thereof), including the capsid proteins.

For brevity and clarity, the disclosure refers to "capsid protein" or "capsid proteins." Those skilled in the art understand that such references refer to VP1, VP2, or VP3, or combinations of VP1, VP2, and VP3. As in wild-type AAV and most recombinant expression systems VP1, VP2, and VP3 are expressed from the same open reading frame, engineering of the sequence that encodes VP3 inevitably alters the sequences of the C-terminal domain of VP1 and VP2. One may also express the capsid proteins from different open reading frames, in which case the capsid of the resulting rAAV virion could contain a mixture of wild-type and engineered capsid proteins, and mixtures of different engineered capsid proteins.

The term "inverted terminal repeats" or "ITRs" as used herein refers to AAV viral cis-elements named so because of their symmetry. These elements are essential for efficient multiplication of an AAV genome. Without being bound by theory, it is believed that the minimal elements indispensable for ITR function are a Rep-binding site and a terminal resolution site plus a variable palindromic sequence allowing for hairpin formation. The disclosure contemplates that alternative means of generating an AAV genome may exist or may be prospectively developed to be compatible with the capsid proteins of the disclosure.

"Helper virus functions" refers to functions encoded in a helper virus genome which allow AAV replication and packaging.

"Packaging" refers to a series of intracellular events that result in the assembly of an rAAV virion including encapsidation of the rAAV vector. AAV "rep" and "cap" genes refer to polynucleotide sequences encoding replication and encapsidation proteins of adeno-associated virus. AAV rep and cap are referred to herein as AAV "packaging genes." Packaging requires either a helper virus itself or, more commonly in recombinant systems, helper virus function supplied by a helper-free system (i.e. one or more helper plasmids).

A "helper virus" for AAV refers to a virus that allows AAV (e.g. wild-type AAV) to be replicated and packaged by a mammalian cell. The helper viruses may be an adenovirus, herpesvirus or poxvirus, such as vaccinia.

An "infectious" virion or viral particle is one that comprises a competently assembled viral capsid and is capable of delivering a polynucleotide component into a cell for which the virion is tropic. The term does not necessarily imply any replication capacity of the virus.

"Infectivity" refers to a measurement of the ability of a virion to inflect a cell. Infectivity can be expressed as the ratio of infectious viral particles to total viral particles. Infectivity is general determined with respect to a particular cell type. It can be measured both in vivo or in vitro. Methods of determining the ratio of infectious viral particle to total viral particle are known in the art. See. e.g., Grainger et al. (2005) *Mol. Ther.* 11:S337 (describing a TCID$_{50}$ infectious titer assay); and Zolotukhin et al. (1999) *Gene Ther.* 6:973.

The terms "parental capsid" or "parental sequence" refer to a reference sequence from which a particle capsid or sequence is derived. Unless otherwise specified, parental sequence refers to the sequence of the wild-type capsid protein of the same serotype as the engineered capsid protein.

A "replication-competent" virus (e.g. a replication-competent AAV) refers to a virus that is infectious, and is also capable of being replicated in an infected cell (i.e. in the presence of a helper virus or helper virus functions). In some embodiments, the rAAV virion of the disclosure comprises a genome that lacks the rep gene, or both the rep and cap genes, and therefore is replication incompetent.

The practice of the present disclosure will employ, unless otherwise indicated, conventional techniques of tissue culture, immunology, molecular biology, cell biology and recombinant DNA, which are within the skill of the art. See, e.g., Sambrook and Russell eds. (2001) Molecular Cloning: A Laboratory Manual, 3$^{rd}$ edition; Ausubel et al. eds. (2007) Current Protocols in Molecular Biology; Methods in Enzymology (Academic Press, Inc., N.Y.); MacPherson et al. (1991) PCR 1: A Practical Approach (IRL Press at Oxford University Press); MacPherson et al. (1995) PCR 2: A Practical Approach; Harlow and Lane eds. (1999) Antibodies, A Laboratory Manual; Freshney (2005) Culture of Animal Cells: A Manual of Basic Technique, 5$^{th}$ edition; Gait ed. (1984) Oligonucleotide Synthesis; U.S. Pat. No. 4,683,195; Hames and Higgins eds. (1984) Nucleic Acid Hybridization; Anderson (1999) Nucleic Acid Hybridization; Hames and Higgins eds. (1984) Transcription and Translation; IRL Press (1986) Immobilized Cells and Enzymes; Perbal (1984) A Practical Guide to Molecular Cloning; Miller and Calos eds. (1987) Gene Transfer Vectors for Mammalian Cells (Cold Spring Harbor Laboratory); Makrides ed. (2003) Gene Transfer and Expression in Mammalian Cells; Mayer and Walker eds. (1987) Immunochemical Methods in Cell and Molecular Biology (Academic Press, London); Herzenberg et al. eds (1996) Weir's Handbook of Experimental Immunology; Manipulating the Mouse Embryo: A Laboratory Manual, 3$^{rd}$ edition (2002) Cold Spring Harbor Laboratory Press; Sohail (2004) Gene Silencing by RNA Interference: Technology and Application (CRC Press); and Sell (2013) Stem Cells Handbook.

The terms "nucleic acid" and "polynucleotide" are used interchangeably and refer to a polymeric form of nucleotides of any length, either deoxyribonucleotides or ribonucleotides, or analogs thereof. Non-limiting examples of polynucleotides include linear and circular nucleic acids, messenger RNA (mRNA), cDNA, recombinant polynucleotides, vectors, probes, and primers. Unless otherwise specified or required, any embodiment of the invention described herein that is a polynucleotide encompasses both the double-stranded form and each of two complementary single-stranded forms known or predicted to make up the double-stranded form.

The terms "polypeptide" and "protein," are used interchangeably herein and refer to a polymeric form of amino acids of any length, which can include genetically coded and non-genetically coded amino acids, chemically or biochemically modified or derivatized amino acids, and polypeptides having modified peptide backbones. The terms also encompass an amino acid polymer that has been modified; for example, disulfide bond formation, glycosylation, lipidation, phosphorylation, or conjugation with a labeling component.

The term "peptide" refers to a short polypeptide, e.g. a peptide having between about 4 and 30 amino acid residues.

The term "isolated" means separated from constituents, cellular and otherwise, in which the virion, cell, tissue, polynucleotide, peptide, polypeptide, or protein is normally associated in nature. For example, an isolated cell is a cell that is separated form tissue or cells of dissimilar phenotype or genotype.

As used herein, "sequence identity" or "identity" refers to the percentage of number of amino acids that are identical between a sequence of interest and a reference sequence. Generally identity is determined by aligning the the sequence of interest to the reference sequence, determining the number of amino acids that are identical between the aligned sequences, dividing that number by the total number of amino acids in the reference sequence, and multiplying the result by 100 to yield a percentage. Sequences can be aligned using various computer programs, such BLAST, available at ncbi.nlm.nih.gov. Other techniques for alignment are described in Methods in Enzymology, vol. 266: Computer Methods for Macromolecular Sequence Analysis (1996); and *Meth. Mol. Biol.* 70: 173-187 (1997); *J. Mol. Biol.* 48: 44. Skill artisans are capable of choosing an appropriate alignment method depending on various factors including sequence length, divergence, and the presence of absence of insertions or deletions with respect to the reference sequence.

"Recombinant," as applied to a polynucleotide means that the polynucleotide is the product of various combinations of cloning, restriction or ligation steps, and other procedures that result in a construct that is distinct from a polynucleotide found in nature, or that the polynucleotide is assembled from synthetic oligonucleotides. A "recombinant" protein is a protein produced from a recombinant polypeptide. A recombinant virion is a virion that comprises a recombinant polynucleotide and/or a recombinant protein, e.g. a recombinant capsid protein.

A "gene" refers to a polynucleotide containing at least one open reading frame that is capable of encoding a particular protein after being transcribed and translated. A "gene product" is a molecule resulting from expression of a particular gene. Gene products may include, without limitation, a polypeptide, a protein, an aptamer, an interfering RNA, or an mRNA. Gene-editing systems (e.g. a CRISPR/Cas system) may be described as one gene product or as the several gene products required to make the system (e.g. a Cas protein and a guide RNA).

A "short hairpin RNA," or shRNA, is a polynucleotide construct used to express an siRNA.

A "control element" or "control sequence" is a nucleotide sequence involved in an interaction of molecules that contributes to the functional regulation of a polynucleotide, including replication, duplication, transcription, splicing, translation, or degradation of the polynucleotide. The regulation may affect the frequency, speed, or specificity of the process, and may be enhancing or inhibitory in nature. Control elements include transcriptional regulatory sequences such as promoters and/or enhancers.

A "promoter" is a DNA sequence capable under certain conditions of binding RNA polymerase and initiating transcription of a coding region usually located downstream (in the 3' direction) from the promoter. The term "tissue-specific promoter" as used herein refers to a promoter that is operable in cells of a particular organ or tissue, such as the cardiac tissue.

"Operatively linked" or "operably linked" refers to a juxtaposition of genetic elements, wherein the elements are in a relationship permitting them to operate in the expected manner. For instance, a promoter is operatively linked to a coding region if the promoter helps initiate transcription of the coding sequence. There may be intervening residues between the promoter and coding region so long as this functional relationship is maintained.

An "expression vector" is a vector comprising a coding sequence which encodes a gene product of interest used to effect the expression of the gene product in target cells. An expression vector comprises control elements operatively linked to the coding sequence to facilitate expression of the gene product.

The term "expression cassette" refers to a heterologous polynucleotide comprising a coding sequence which encodes a gene product of interest used to effect the expression of the gene product in target cells. Unless otherwise specified, the expression cassette of an AAV vector include the polynucleotides between (and not including) the ITRs.

The term "gene delivery" or "gene transfer" as used herein refers to methods or systems for reliably inserting foreign nucleic acid sequences, e.g., DNA, into host cells. Such methods can result in transient expression of non-integrated transferred DNA, extrachromosomal replication and expression of transferred replicons (e.g., episomes), or integration of transferred genetic material into the genomic DNA of host cells.

"Heterologous" means derived from a genotypically distinct entity from that of the rest of the entity to which it is being compared. For example, a polynucleotide introduced by genetic engineering techniques into a plasmid or vector derived from a different species is a heterologous polynucleotide. A promoter removed from its native coding sequence and operatively linked to a coding sequence with which it is not naturally found linked is a heterologous promoter. Thus, for example, an rAAV that includes a heterologous nucleic acid is an rAAV that includes a nucleic acid not normally included in a naturally-occurring AAV.

The terms "genetic alteration" and "genetic modification" (and grammatical variants thereof), are used interchangeably herein to refer to a process wherein a genetic element (e.g., a polynucleotide) is introduced into a cell other than by mitosis or meiosis. The element may be heterologous to the cell, or it may be an additional copy or improved version of an element already present in the cell. Genetic alteration may be effected, for example, by transfecting a cell with a recombinant plasmid or other polynucleotide through any process known in the art, such as electroporation, calcium phosphate precipitation, or contacting with a polynucleotide-liposome complex. Genetic alteration may also be effected, for example, by transduction or infection with a vector.

A cell is said to be "stably" altered, transduced, genetically modified, or transformed with a polynucleotide sequence if the sequence is available to perform its function during extended culture of the cell in vitro. Generally, such a cell is "heritably" altered (genetically modified) in that a genetic alteration is introduced which is also inheritable by progeny of the altered cell.

The term "transfection" is as used herein refers to the uptake of an exogenous nucleic acid molecule by a cell. A cell has been "transfected" when exogenous nucleic acid has been introduced inside the cell membrane. A number of transfection techniques are generally known in the art. See. e.g., Graham et al. (1973) *Virology*, 52:456, Sambrook et al. (1989) Molecular Cloning, a laboratory manual, Cold Spring Harbor Laboratories, New York, Davis et al. (1986) Basic Methods in Molecular Biology, Elsevier, and Chu et al. (1981) *Gene* 13:197. Such techniques can be used to introduce one or more exogenous nucleic acid molecules into suitable host cells.

The term "transduction" is as used herein refers to the transfer of an exogenous nucleic acid into a cell by a recombinant virion, in contrast to "infection" by a wild-type virion. When infection is used with respect to a recombinant virion, the terms "transduction" and "infectious" are synonymous, and therefore "infectivity" and "transduction efficiency" are equivalent and can be determined using similar methods.

Unless otherwise specified, all medical terminology is given the ordinary meaning of the term used by medical professional as, for example, in *Harrison's Principles of Internal Medicine,* 15ed., which is incorporated by reference in its entirety for all purposes, in particular the chapters on cardiac or cardiovascular diseases, disorders, conditions, and dysfunctions.

"Treatment," "treating," and "treat" are defined as acting upon a disease, disorder, or condition with an agent to reduce or ameliorate harmful or any other undesired effects of the disease, disorder, or condition and/or its symptoms.

"Administration," "administering" and the like, when used in connection with a composition of the invention refer both to direct administration (administration to a subject by a medical professional or by self-administration by the subject) and/or to indirect administration (prescribing a composition to a patient). Typically, an effective amount is administered, which amount can be determined by one of skill in the art. Any method of administration may be used. Administration to a subject can be achieved by, for example, intravenous, intrarterial, intramuscular, intravascular, or intramyocardial delivery.

As used herein the term "effective amount" and the like in reference to an amount of a composition refers to an amount that is sufficient to induce a desired physiologic outcome (e.g., reprogramming of a cell or treatment of a disease). An effective amount can be administered in one or more administrations, applications or dosages. Such delivery is dependent on a number of variables including the time period which the individual dosage unit is to be used, the bioavailability of the composition, the route of administration, etc. It is understood, however, that specific amounts of the compositions (e.g., rAAV virions) for any particular subject depends upon a variety of factors including the activity of the specific agent employed, the age, body weight, general health, sex, and diet of the subject, the time of administration, the rate of excretion, the composition combination, severity of the particular disease being treated and form of administration.

The terms "individual," "subject," and "patient" are used interchangeably herein, and refer to a mammal, including, but not limited to, human and non-human primates (e.g., simians); mammalian sport animals (e.g., horses); mammalian farm animals (e.g., sheep, goats, etc.); mammalian pets (e.g., dogs, cats, etc.); and rodents (e.g., mice, rats, etc.).

The terms "cardiac pathology" or "cardiac dysfunction" are used interchangeably and refer to any impairment in the heart's pumping function. This includes, for example, impairments in contractility, impairments in ability to relax (sometimes referred to as diastolic dysfunction), abnormal or improper functioning of the heart's valves, diseases of the heart muscle (sometimes referred to as cardiomyopathies), diseases such as angina pectoris, myocardial ischemia and/or infarction characterized by inadequate blood supply to the heart muscle, infiltrative diseases such as amyloidosis and hemochromatosis, global or regional hypertrophy (such as may occur in some kinds of cardiomyopathy or systemic hypertension), and abnormal communications between chambers of the heart.

As used herein, the term "cardiomyopathy" refers to any disease or dysfunction that affects myocardium directly. The etiology of the disease or disorder may be, for example, inflammatory, metabolic, toxic, infiltrative, fibroplastic, hematological, genetic, or unknown in origin. Two fundamental forms are recognized (1) a primary type, consisting of heart muscle disease of unknown cause; and (2) a secondary type, consisting of myocardial disease of known cause or associated with a disease involving other organ systems. "Specific cardiomyopathy" refers to heart diseases associated with certain systemic or cardiac disorders; examples include hypertensive and metabolic cardiomyopathy. The cardiomyopathies include dilated cardiomyopathy (DCM), a disorder in which left and/or right ventricular systolic pump function is impaired, leading to progressive cardiac enlargement; hypertrophic cardiomyopathy, characterized by left ventricular hypertrophy without oblivious causes such as hypertension or aortic stenosis; and restrictive cardiomyopathy, characterized by abnormal diastolic function and excessively rigid ventricular walls that impede ventricular filling. Cardiomyopathies also include left ventricular non-compaction, arrhythmogenic right ventricular cardiomyopathy, and arrhythmogenic right ventricular dysplasia.

"Heart failure" referees to the pathological state in which an abnormality of cardiac function is responsible for failure of the hear to pump blood at a rate commensurate with the requirements of the metabolizing tissues and/or allows the heart to do so only from an abnormally elevated diastolic volume. Heart failure includes systolic and diastolic failure. Patient with heart failure are classified into those with low cardiac output (typically secondary to ischemic heart disease, hypertension, dilated cardiomyopathy, and/or valvular or pericardial disease) and those with elevated cardiac output (typically due to hyperthyroidism, anemia, pregnancy, arteriovenous fistulas, beriberi, and Paget's disease). Heart failure includes heart failure with reduced ejection fraction (HFrEF) and heart failure with preserved ejection fraction (HFpEF).

The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The term "purified" as used herein refers to material that has been isolated under conditions that reduce or eliminate the presence of unrelated materials, i.e. impurities, including native materials from which the material is obtained. For example, purified rAAV vector DNA is preferably substantially free of cell or culture components, including tissue culture components, contaminants, and the like.

The terms "regenerate," "regeneration" and the like as used herein in the context of injured cardiac tissue shall be given their ordinary meanings and shall also refer to the process of growing and/or developing new cardiac tissue in a heart or cardiac tissue that has been injured, for example, injured due to ischemia, infarction, reperfusion, or other disease. In some embodiments, cardiac tissue regeneration comprises generation of cardiomyocytes.

The term "therapeutic gene" as used herein refers to a gene that, when expressed, confers a beneficial effect on the cell or tissue in which it is present, or on a mammal in which the gene is expressed. Examples of beneficial effects include amelioration of a sign or symptom of a condition or disease, prevention or inhibition of a condition or disease, or conferral of a desired characteristic. Therapeutic genes include genes that partially or wholly correct a genetic deficiency in a cell or mammal.

As used herein, the term "functional cardiomyocyte" refers to a differentiated cardiomyocyte that is able to send or receive electrical signals. In some embodiments, a cardiomyocyte is said to be a functional cardiomyocyte if it exhibits electrophysiological properties such as action potentials and/or $Ca^{2+}$ transients.

As used herein, a "differentiated non-cardiac cell" can refer to a cell that is not able to differentiate into all cell types of an adult organism (i.e., is not a pluripotent cell), and which is of a cellular lineage other than a cardiac lineage (e.g., a neuronal lineage or a connective tissue lineage). Differentiated cells include, but are not limited to, multipotent cells, oligopotent cells, unipotent cells, progenitor cells, and terminally differentiated cells. In particular embodiments, a less potent cell is considered "differentiated" in reference to a more potent cell.

A "somatic cell" is a cell forming the body of an organism. Somatic cells include cells making up organs, skin, blood, bones and connective tissue in an organism, but not germ cells.

As used herein, the term "totipotent" means the ability of a cell to form all cell lineages of an organism. For example, in mammals, only the zygote and the first cleavage stage blastomeres are totipotent.

As used herein, the term "pluripotent" means the ability of a cell to form all lineages of the body or soma. For example, embryonic stem cells are a type of pluripotent stem cells that are able to form cells from each of the three germs layers, the ectoderm, the mesoderm, and the endoderm. Pluripotent cells can be recognized by their expression of markers such as Nanog and Rex1.

As used herein, the term "multipotent" refers to the ability of an adult stem cell to form multiple cell types of one lineage. For example, hematopoietic stem cells are capable of forming all cells of the blood cell lineage, e.g., lymphoid and myeloid cells.

As used herein, the term "oligopotent" refers to the ability of an adult stem cell to differentiate into only a few different cell types. For example, lymphoid or myeloid stem cells are capable of forming cells of either the lymphoid or myeloid lineages, respectively.

As used herein, the term "unipotent" means the ability of a cell to form a single cell type. For example, spermatogonial stem cells are only capable of forming sperm cells.

As used herein, the term "reprogramming" or "transdifferentiation" refers to the generation of a cell of a certain lineage (e.g., a cardiac cell) from a different type of cell (e.g., a fibroblast cell) without an intermediate process of de-differentiating the cell into a cell exhibiting plurinpotent stem cell characteristics.

As used herein the term "cardiac cell" refers to any cell present in the heart that provides a cardiac function, such as heart contraction or blood supply, or otherwise serves to maintain the structure of the heart. Cardiac cells as used herein encompass cells that exist in the epicardium, myocardium or endocardium of the heart. Cardiac cells also include, for example, cardiac muscle cells or cardiomyocytes, and cells of the cardiac vasculatures, such as cells of a coronary artery or vein. Other non-limiting examples of cardiac cells include epithelial cells, endothelial cells, fibroblasts, cardiac stem or progenitor cells, cardiac conducting cells and cardiac pacemaking cells that constitute the cardiac muscle, blood vessels and cardiac cell supporting structure. Cardiac cells may be derived from stem cells, including, for example, embryonic stem cells or induced pluripotent stem cells.

The term "cardiomyocyte" or "cardiomyocytes" as used herein refers to sarcomere-containing striated muscle cells, naturally found in the mammalian heart, as opposed to skeletal muscle cells. Cardiomyocytes are characterized by the expression of specialized molecules e.g., proteins like myosin heavy chain, myosin light chain, cardiac α-actinin. The term "cardiomyocyte" as used herein is an umbrella term comprising any cardiomyocyte subpopulation or cardiomyocyte subtype, e.g., atrial, ventricular and pacemaker cardiomyocytes.

The term "cardiomyocyte-like cells" is intended to mean cells sharing features with cardiomyocytes, but which may not share all features. For example, a cardiomyocyte-like cell may differ from a cardiomyocyte in expression of certain cardiac genes.

The term "culture" or "cell culture" means the maintenance of cells in an artificial, in vitro environment. A "cell culture system" is used herein to refer to culture conditions in which a population of cells may be grown as monolayers or in suspension. "Culture medium" is used herein to refer to a nutrient solution for the culturing, growth, or proliferation of cells. Culture medium may be characterized by functional properties such as, but not limited to, the ability to maintain cells in a particular state (e.g., a pluripotent state, a quiescent state, etc.), to mature cells—in some instances, specifically, to promote the differentiation of progenitor cells into cells of a particular lineage (e.g., a cardiomyocyte).

As used herein, the term "expression" or "express" refers to the process by which polynucleotides are transcribed into mRNA and/or the process by which the transcribed mRNA is subsequently being translated into peptides, polypeptides, or proteins. If the polynucleotide is derived from genomic DNA, expression may include splicing of the mRNA in a eukaryotic cell. The expression level of a gene may be determined by measuring the amount of mRNA or protein in a cell or tissue sample.

The term "induced cardiomyocyte" or the abbreviation "iCM" refers to a non-cardiomyocyte (and its progeny) that has been transformed into a cardiomyocyte (and/or cardiomyocyte-like cell). The methods of the present disclosure can be used in conjunction with any methods now known or later discovered for generating induced cardiomyocytes, for example, to enhance other techniques.

The term "induced pluripotent stem cell-derived cardiomyocytes" as used herein refers to human induced pluripotent stem cells that have been differentiated into cardiomyocyte-like cells. Exemplary methods for prepared iPS-CM cells are provided by Karakikes et al. *Circ Res.* 2015 Jun. 19; 117(1): 80-88.

The terms "human cardiac fibroblast" and "mouse cardiac fibroblast" as used herein refer to primary cell isolated from the ventricles of the adult heart of a human or mouse, respectively, and maintain in culture ex vivo.

The term "non-cardiomyocyte" as used herein refers to any cell or population of cells in a cell preparation not fulfilling the criteria of a "cardiomyocyte" as defined and used herein. Non-limiting examples of non-cardiomyocytes include somatic cells, cardiac fibroblasts, non-cardiac fibroblasts, cardiac progenitor cells, and stem cells.

As used herein "reprogramming" includes transdifferentiation, dedifferentiation and the like.

As used herein, the term "reprogramming efficiency" refers to the number of cells in a sample that are successfully reprogrammed to cardiomyocytes relative to the total number of cells in the sample.

The term "reprogramming factor" as used herein includes a factor that is introduced for expression in a cell to assist in the reprogramming of the cell from one cell type into another. For example, a reprogramming factor may include a transcription factor that, in combination with other transcription factors and/or small molecules, is capable of reprogramming a cardiac fibroblast into an induced cardiomyocyte. Unless otherwise clear from context, a reprogramming factor refers to a polypeptide that can be encoded by an AAV-delivered polynucleotide. Reprogramming factors may also include small molecules.

The term "stem cells" refer to cells that have the capacity to self-renew and to generate differentiated progeny. The term "pluripotent stem cells" refers to stem cells that can give rise to cells of all three germ layers (endoderm, mesoderm and ectoderm), but do not have the capacity to give rise to a complete organism.

As used herein, the term "equivalents thereof" in reference to a polypeptide or nucleic acid sequence refers to a polypeptide or nucleic acid that differs from a reference polypeptide or nucleic acid sequence, but retains essential properties (e.g., biological activity). A typical variant of a polynucleotide differs in nucleotide sequence from another, reference polynucleotide. Changes in the nucleotide sequence of the variant may or may not alter the amino acid sequence of a polypeptide encoded by the reference polynucleotide. Nucleotide changes may result in amino acid substitutions, deletions, additions, fusions and truncations in the polypeptide encoded by the reference sequence. Generally, differences are limited so that the sequences of the reference polypeptide and the variant are closely similar overall and, in many regions, identical.

As used herein, the term "progenitor cell" refers to a cell that is committed to differentiate into a specific type of cell or to form a specific type of tissue. A progenitor cell, like a stem cell, can further differentiate into one or more kinds of cells, but is more mature than a stem cell such that it has a more limited/restricted differentiation capacity.

The term "genetic modification" refers to a permanent or transient genetic change induced in a cell following introduction of new nucleic acid (i.e., nucleic acid exogenous to the cell). Genetic change can be accomplished by incorporation of the new nucleic acid into the genome of the cardiac cell, or by transient or stable maintenance of the new nucleic acid as an extrachromosomal element. Where the cell is a eukaryotic cell, a permanent genetic change can be achieved by introduction of the nucleic acid into the genome of the cell. Suitable methods of genetic modification include viral infection, transfection, conjugation, protoplast fusion, electroporation, particle gun technology, calcium phosphate precipitation, direct microinjection, and the like.

The term "stem cells" refer to cells that have the capacity to self-renew and to generate differentiated progeny. The term "pluripotent stem cells" refers to stem cells that can give rise to cells of all three germ layers (endoderm, mesoderm and ectoderm), but do not have the capacity to give rise to a complete organism. In some embodiments, the compositions for inducing cardiomycocyte phenotype can be used on a population of cells to induce reprogramming. In other embodiments, the compositions induce a cardiomyocyte phenotype.

The term "induced pluripotent stem cells" shall be given its ordinary meaning and shall also refer to differentiated mammalian somatic cells (e.g., adult somatic cells, such as skin) that have been reprogrammed to exhibit at least one characteristic of pluripotency. See, for example, Takahashi et al. (2007) *Cell* 131(5):861-872, Kim et al. (2011) *Proc. Natl. Acad. Sci.* 108(19): 7838-7843, Sell (2013) Stem Cells Handbook.

The term "transduction efficiency" refers to the percentage of cells transduced with at least one AAV genome. For example, if $1 \times 10^6$ cells are exposed to a virus and $0.5 \times 10^6$ cells are determined to contain at least one copy of the AAV genome, then the transduction efficiency is 50%. An illustrative method for determining transduction efficiency is flow cytometry. For example, the percentage of GFP+ cells is a measure of transduction efficiency when the AAV genome comprises a polynucleotide encoding green fluorescence protein (GFP).

The term "selectivity" refers to the ratio of transduction efficiency for one cell type over another, or over all other cells types.

The term "infectivity" refers to the ability of an AAV virion to infect a cell, in particularly an in vivo cell. Infectivity therefore is a function of, at least, biodistribution and neutralizing antibody escape.

Unless stated otherwise, the abbreviations used throughout the specification have the following meanings: AAV, adeno-associated virus, rAAV, recombinant adeno-associated virus; AHCF, adult human cardiac fibroblast; APCF, adult pig cardiac fibroblast, a-MHC-GFP; alpha-myosin heavy chain green fluorescence protein; CF, cardiac fibroblast; cm, centimeter; CO, cardiac output; EF, ejection fraction; FACS, fluorescence activated cell sorting; GFP, green fluorescence protein; GMT, Gata4, Mef2c and Tbx5; GMTc, Gata4, Mef2c, Tbx5, TGF-βi, WNTi; GO, gene ontology; hCF, human cardiac fibroblast; iCM, induced cardiomyocyte; kg, killigram; μg, microgram; pd, microliter; mg, milligram; ml, milliliter; MI, myocardial infarction; msec, millisecond; min, minute; MyAMT, Myocardin, Ascl1, Mef2c and Tbx5; MyA, Myocardin and Ascl1;

MyMT, Myocardin, Mef2c and Tbx5; MyMTc, Myocardin, Mef2c, Tbx5, TGF-βi, WNTi; MRI, magnetic resonance imaging; PBS, phosphate buffered saline; PBST, phosphate buffered saline, triton; PFA, paraformaldehyde; qPCR, quantitative polymerase chain reaction; qRT-PCR, quantitative reverse transcriptase polymerase chain reaction; RNA, ribonucleic acid; RNA-seq, RNA sequencing; RT-PCR, reverse transcriptase polymerase chain reaction; sec, second; SV, stroke volume; TGF-β, transforming growth factor beta; TGF-βi, transforming growth factor beta inhibitor; WNT, wingless-Int; WNTi, wingless-Int inhibitor; YFP, yellow fluorescence protein; 4F, Gata4, Mef2c, TBX5, and Myocardin; 4Fc, Gata4, Mef2c, TBX5, and Myocardin+TGF-βi and WNTi; 7F, Gata4, Mef2c, and Tbx5, Essrg, Myocardin, Zfpm2, and Mesp1; 7Fc, Gata4, Mef2c, and Tbx5, Essrg, Myocardin, Zfpm2, and Mesp1+TGF-0 and WNTi.

EMBODIMENTS AND VARIATIONS

Compositions

Efforts to identify capsid variants with properties useful for gene therapy have included shuffling the DNA of AAV2 and AAV5 cap genes as described in U.S. Pat. No. 9,233, 131; as well as directed evolution as described in Int'l Pat. Appl. Nos. WO2012/145601A2 and WO2018/222503A1. The disclosures of these documents are incorporated here for all purposes, and particularly for the methods of making and using AAV virions and for the polynucleotide sequences and gene products therein disclosed, as well as for the combinations of transcription factors useful in treating cardiac diseases or disorders.

The AAV capsid is encoded by the cap gene of AAV, which is also termed the right open-reading frame (ORF) (in contrast to the left ORF, rep). The structures of representative AAV capsids are described in various publications including Xie et al. (2002)*Proc. Natl. Acad. Sci USA* 99:10405-1040 (AAV2); Govindasamy et al. (2006) *J. Virol.* 80:11556-11570 (AAV4); Nam et a. (2007) *J. Virol.* 81:12260-12271 (AAV8) and Govindasamy et al. (2013)*J. Virol.* 87:11187-11199 (AAV5).

The AAV capsid contain 60 copies (in total) of three viral proteins (VPs), VP1, VP2, and VP3, in a predicted ratio of 1:1:10, arranged with T=1 icosahedral symmetry. The three VPs are translated from the same mRNA, with VP1 containing a unique N-terminal domain in addition to the entire VP2 sequence at its C-terminal region. VP2 contains an extra N-terminal sequence in addition to VP3 at its C terminus. In most crystal structures, only the C-terminal polypeptide sequence common to all the capsid proteins (~530 amino acids) is observed. The N-terminal unique region of VP1, the VP1-VP2 overlapping region, and the first 14 to 16 N-terminal residues of VP3 are thought to be primarily disordered. Cryo-electron microscopy and image reconstruction data suggest that in intact AAV capsids, the N-terminal regions of the VP1 and VP2 proteins are located inside the capsid and are inaccessible for receptor and antibody binding. Thus, receptor attachment and transduction phenotypes are, generally, determined by the amino acid sequences within the common C-terminal domain of VP1, VP2 and VP3

In some embodiments, the one or more amino acid insertions, substitutions, or deletions is/are in the GH loop, or loop IV, of the AAV capsid protein, e.g., in a solvent-accessible portion of the GH loop, or loop IV, of the AAV capsid protein. For the GH loop/loop IV of AAV capsid, see. e.g., van Vliet et al. (2006) *Mol. Ther.* 14:809; Padron et al. (2005) *Virol.* 79:5047; and Shen et al. (2007)*Mol. Ther.* 15:

1955. In some embodiments, a "parental" AAV capsid protein is a wild-type AAV5 capsid protein. In some embodiments, a "parental" AAV capsid protein is a chimeric AAV capsid protein. Amino acid sequences of various AAV capsid proteins are known in the art. See, e.g., GenBank Accession No. NP_049542 for AAV1; GenBank Accession No. NP_044927 for AAV4; GenBank Accession No. AAD13756 for AAV5; GenBank Accession No. AAB95450 for AAV6; GenBank Accession No. YP_077178 for AAV7; GenBank Accession No. YP_077180 for AAV 8; GenBank Accession No. AAS99264 for AAV9 and GenBank Accession No. AAT46337 for AAV10. See, e.g., Santiago-Ortiz et al. (2015) *Gene Ther.* 22:934 for a predicted ancestral AAV capsid.

Adeno-associated virus (AAV) is a replication-deficient parvovirus, the single-stranded DNA genome of which is about 4.7 kb in length including two 145 nucleotide inverted terminal repeat (ITRs). There are multiple serotypes of AAV. The nucleotide sequences of the genomes of the AAV serotypes are known. For example, the AAV5 genome is provided in GenBank Accession No. AF085716. The life cycle and genetics of AAV are reviewed in Muzyczka, *Current Topics in Microbiology and Immunology,* 158: 97-129 (1992). Production of pseudotyped rAAV is disclosed in, for example, WO 01/83692. Other types of rAAV variants, for example rAAV with capsid mutations, are also contemplated. See, for example, Marsic et al., *Molecular Therapy,* 22(11): 1900-1909 (2014). Illustrative AAV vectors are provided in U.S. Pat. No. 7,105,345; U.S. Ser. No. 15/782,980; U.S. Pat. Nos. 7,259,151; 6,962,815; 7,718, 424; 6,984,517; 7,718,424; 6,156,303; 8,524,446; 7,790, 449; 7,906,111; 9,737,618; U.S. application Ser. No. 15/433, 322; U.S. Pat. No. 7,198,951, each of which is incorporated by reference in its entirety for all purposes.

The rAAV virions of the disclosure comprise a heterologous nucleic acid comprising a nucleotide sequence encoding one or more gene product. The gene product(s) may be either a polypeptide or an RNA, or both. When the gene product is a polypeptide, the nucleotide sequence encodes a messenger RNA, optionally with one or more introns, which is translated into the gene product polypeptide. The nucleotide sequence may encode one, two, three, or more gene products (though the number is limited by the packaging capacity of the rAAV virion, typically about 5.2 kb). The gene products may be operatively linked to one promoter (for a single transcriptional unit) or more than one. Multiple gene products may also be produced using internal ribosome entry signal (IRES) or a self-cleaving peptide (e.g., a 2A peptide).

In some embodiments, the gene product is a polypeptide. In some embodiments, the polypeptide gene product is a polypeptide that induces reprogramming of a cardiac fibroblast, to generate an induced cardiomyocyte-like cell (iCM). In some embodiments, the polypeptide gene product is a polypeptide that enhances the function of a cardiac cell. In some embodiments, the polypeptide gene product is a polypeptide that provides a function that is missing or defective in the cardiac cell. In some embodiments, the polypeptide gene product is a genome-editing endonuclease.

In some embodiments, the gene product comprises a fusion protein that is fused to a heterologous polypeptide. In some embodiments, the gene product comprises a genome editing nuclease fused to an amino acid sequence that provides for subcellular localization, i.e., the fusion partner is a subcellular localization sequence (e.g., one or more nuclear localization signals (NLSs) for targeting to the nucleus, two or more NLSs, three or more NLSs, etc.).

In general, a viral vector is produced by introducing a viral DNA or RNA construct into a "producer cell" or "packaging cell" line. Packaging cell lines include but are not limited to any easily-transfectable cell line. Packaging cell lines can be based on HEK291, 293T cells, NIH3T3, COS, HeLa or Sf9 cell lines. Examples of packaging cell lines include but are not limited to: Sf9 (ATCC® CRL-1711™). Exemplary packing cell lines and methods for generating rAAV virions are provided by Int'l Pat. Pub. Nos. WO2017075627, WO2015/031686, WO2013/063379, WO2011/020710, WO2009/104964, WO2008/024998, WO2003/042361, and WO1995/013392; U.S. Pat. Nos. U.S. Pat. No. 9,441,206B2, U.S. Pat. Nos. 8,679,837, and 7,091,029B2.

In some embodiments, the gene product is a functional cardiac protein. In some embodiments, the gene product is a genome-editing endonuclease (optionally with a guide RNA, single-guide RNA, and/or repair template) that replaces or repairs a non-functional cardiac protein into a functional cardiac protein. Functional cardiac proteins include, but are not limited to cardiac troponin T; a cardiac sarcomeric protein; β-myosin heavy chain; myosin ventricular essential light chain 1; myosin ventricular regulatory light chain 2; cardiac a-actin; a-tropomyosin; cardiac troponin I; cardiac myosin binding protein C; four-and-a-half LIM protein 1; titin; 5'-AMP-activated protein kinase subunit gamma-2; troponin I type 3, myosin light chain 2, actin alpha cardiac muscle 1; cardiac LIM protein; caveolin 3 (CAV3); galactosidase alpha (GLA); lysosomal-associated membrane protein 2 (LAMP2); mitochondrial transfer RNA glycine (MTTG); mitochondrial transfer RNA isoleucine (MTTI); mitochondrial transfer RNA lysine (MTTK); mitochondrial transfer RNA glutamine (MTTQ); myosin light chain 3 (MYL3); troponin C (TNNC1); transthyretin (TTR); sarcoendoplasmic reticulum calcium-ATPase 2a (SERCA2a); stromal-derived factor-1 (SDF-1); adenylate cyclase-6 (AC6); beta-ARKct (β-adrenergic receptor kinase C terminus); fibroblast growth factor (FGF); platelet-derived growth factor (PDGF); vascular endothelial growth factor (VEGF); hepatocyte growth factor; hypoxia inducible growth factor; thymosin beta 4 (TMSB4X); nitric oxide synthase-3 (NOS3); unocartin 3 (UCN3); melusin; apoplipoprotein-E (ApoE); superoxide dismutase (SOD); and S100A1 (a small calcium binding protein; see, e.g., Ritterhoff and Most (2012) Gene Ther. 19:613; Kraus et al. (2009) Mol. Cell. Cardiol. 47:445).

In some embodiments, the gene product is a gene product whose expression complements a defect in a gene responsible for a genetic disorder. The disclosure provides rAAV virions comprising a polynucleotide encoding one or more of the following—e.g., for use, without limitation, in the disorder indicated in parentheses, or for other disorders caused by each: TAZ (Barth syndrome); FXN (Freidrich's Ataxia); CASQ2 (CPVT); FBN1 (Marfan); RAF1 and SOSis (Noonan); SCN5A (Brugada); KCNQ1 and KCNH2s (Long QT Syndrome); DMPK (Myotonic Dystrophy 1); LMNA (Limb Girdle Dystrophy Type 1B); JUP (Naxos); TGFBR2 (Loeys-Dietz); EMD (X-Linked EDMD); and ELN (SV Aortic Stenosis). In some embodiments, the rAAV virion comprises a polynucleotide encoding one or more of cardiac troponin T (TNNT2); BAG family molecular chaperone regulator 3 (BAG3); myosin heavy chain (MYH7); tropomyosin 1 (TPM1); myosin binding protein C (MYBPC3); 5'-AMP-activated protein kinase subunit gamma-2 (PRKAG2); troponin I type 3 (TNNI3); titin (TTN); myosin, light chain 2 (MYL2); actin, alpha cardiac muscle 1 (ACTC1); potassium voltage-gated channel, KQT-like subfamily, member 1 (KCNQ1); plakophilin 2 (PKP2); myocyte enhancer factor 2c (MEF2C); and cardiac LIM protein (CSRP3).

In some embodiments, the gene products of the disclosure are polypeptide reprogramming factors. Reprogramming factors are desirable as means to convert one cell type into another. Non-cardiomyocytes cells can be differentiated into cardiomyocytes cells in vitro or in vivo using any method available to one of skill in the art. For example, see methods described in Ieda et al. (2010) Cell 142:375-386; Christoforou et al. (2013) PLoS ONE 8:e63577; Addis et al. (2013) J. Mol. Cell Cardiol. 60:97-106; Jayawardena et al. (2012) Circ. Res. 110: 1465-1473; Nam Y et al. (2003) PNAS USA 110:5588-5593; Wada R et al. (2013) PNAS USA 110: 12667-12672; and Fu J et al. (2013) Stem Cell Reports 1:235-247.

In cardiac context, the reprogramming factors may be capable of converting a cardiac fibroblast to a cardiac myocyte either directly or through an intermediate cell type. In particular, direct regramming is possible, or reprogramming by first converting the fibroblast to a pluripotent or totipotent stem cell. Such a pluripotent stem cell is termed an induced pluripotent stem (iPS) cell. An iPS cell that is subsequently converted to a cardiac myocyte (CM) cell is termed an iPS-CM cell. In the examples, iPS-CM derived in vitro from cardiac fibroblasts are used in vivo to select capsid proteins of interest. The disclosure also envisions using the capsid proteins disclosure to in turn generate iPS-CM cells in vitro but, particular, in vivo, as part of a therapeutic gene therapy regimen. Induced cardiomyocyte-like (iCM) cells refer to cells directly reprogrammed into cardiomyocytes.

Induced cardiomyocytes express one or more cardiomyocyte-specific markers, where cardiomyocyte-specific markers include, but are not limited to, cardiac troponin I, cardiac troponin-C, tropomyosin, caveolin-3, myosin heavy chain, myosin light chain-2a, myosin light chain-2v, ryanodine receptor, sarcomeric a-actinin, Nkx2.5, connexin 43, and atrial natriuretic factor. Induced cardiomyocytes can also exhibit sarcomeric structures. Induced cardiomyocytes exhibit increased expression of cardiomyocyte-specific genes ACTC1 (cardiac a-actin), ACTN2 (actinin a2), MYH6 (a-myosin heavy chain), RYR2 (ryanodine receptor 2), MYL2 (myosin regulatory light chain 2, ventricular isoform), MYL7 (myosin regulatory light chain, atrial isoform), TNNT2 (troponin T type 2, cardiac), and NPPA (natriuretic peptide precursor type A), PLN (phospholamban). Expression of fibroblasts markers such as Colla2 (collagen la2) is downregulated in induced cardiomyocytes, compared to fibroblasts from which the iCM is derived.

Reprogramming methods involving polypeptide reprogramming factors (in some cases supplemented by small-molecule reprogramming factors supplied in conjuction with the rAAV) include those described in US2018/0112282A1, WO2018/005546, WO2017/173137, US2016/0186141, US2016/0251624, US2014/0301991, and US2013/0216503A1, which are incorporated in their entirety, particularly for the reprogramming methods and factors disclosed.

In some embodiments, cardiac cells are reprogrammed into induced cardiomyocyte-like (iCM) cells using one or more reprogramming factors that modulate the expression of one or more polynucleotides or proteins of interest, such as Achaete-scute homolog 1 (ASCL1), Myocardin (MYOCD), myocyte-specific enhancer factor 2C (MEF2C), and/or T-box transcription factor 5 (TBX5). In some embodiments, the one or more reprogramming factors are provided as a polynucleotide (e.g., an RNA, an mRNA, or a DNA poly-nucleotide) that encode one or more polynucleotides or proteins of interest. In some embodiments, the one or more reprogramming factors are provided as a protein.

In some embodiments, the reprogramming factors are microRNAs or microRNA antagonists, siRNAs, or small molecules that are capable of increasing the expression of one or more polynucleotides or proteins of interest. In some embodiments, expression of a polynucleotides or proteins of interest is increased by expression of a microRNA or a microRNA antagonist. For example, endogenous expression of an Oct polypeptide can be increased by introduction of microRNA-302 (miR-302), or by increased expression of miR-302. See. e.g., Hu et al., *Stem Cells* 31(2): 259-68 (2013), which is incorporated herein by reference in its entirety. Hence, miRNA-302 can be an inducer of endog-enous Oct polypeptide expression. The miRNA-302 can be introduced alone or with a nucleic acid that encodes the Oct polypeptide. In some embodiments, a suitable nucleic acid gene product is a microRNA. Suitable micrRNAs include, e.g., mir-1, mir-133, mir-208, mir-143, mir-145, and mir-499.

In some embodiments, the methods of the disclosure comprise administering an rAAV virion of the disclosure before, during, or after administration of the small-molecule reprogramming factor. In some embodiments, the small-molecule reprogramming factor is a small molecule selected from the group consisting of SB431542, LDN-193189, dexamethasone, LY364947, D4476, myricetin, IWR1, XAV939, docosahexaenoic acid (DHA), S-Nitroso-TV-acetylpenicillamine (SNAP), Hh-Agl.5, alprostadil, cro-makalim, MNITMT, A769662, retinoic acid p-hydoxyan-lide, decamethonium dibromide, nifedipine, piroxicam, bacitracin, aztreonam, harmalol hydrochloride, amide-C2 (A7), Ph-C12 (CIO), mCF3-C-7 (J5), G856-7272 (A473), 5475707, or any combination thereof.

In some embodiments, the gene products comprise repro-gramming factors that modulate the expression of one or more proteins of interest selected from ASCL1, MYOCD, MEF2C, and TBX5. In some embodiments, the gene prod-ucts comprise one or more reprogramming factors selected from ASCL1, MYOCD, MEF2C, AND TBX5, CCNB1, CCND1, CDK1, CDK4, AURKB, OCT4, BAF60C, ESRRG, GATA4, GATA6, HAND2, IRX4, ISLL, MESP1, MESP2, NKX2.5, SRF, TBX20, ZFPM2, and miR-133.

In some embodiments, the gene products comprise GATA4, MEF2C, and TBX5 (i.e., GMT). In some embodi-ments, the gene products comprise MYOCD, MEF2C, and TBX5 (i.e., MyMT). In some embodiments, the gene prod-ucts comprise MYOCD, ASCL1, MEF2C, and TBX5 (i.e., MyAMT). In some embodiments, the gene products com-prise MYOCD and ASCL1 (i.e., MyA). In some embodi-ments, the gene products comprise GATA4, MEF2C, TBX5, and MYOCD (i.e., 4F). In other embodiments, the gene products comprise GATA4, MEF2C, TBX5, ESSRG, MYOCD, ZFPM2, and MESP1 (i.e., 7F). In some embodi-ments, the gene products comprise one or more of ASCL1, MEF2C, GATA4, TBX5, MYOCD, ESRRG, AND MESPL.

In some embodiments, the rAAV virions generate cardiac myocytes in vitro or in vivo. Cardiomyocytes or cardiac myocytes are the muscle cells that make up the cardiac muscle. Each myocardial cell contains myofibrils, which are long chains of sarcomeres, the contractile units of muscle cells. Cardiomyocytes show striations similar to those on skeletal muscle cells, but unlike multinucleated skeletal cells, they contain only one nucleus. Cardiomyocytes have a high mitochondrial density, which allows them to produce ATP quickly, making them highly resistant to fatigue. Mature cardiomyocytes can express one or more of the following cardiac markers: α-Actinin, MLC2v, MY20, cMHC, NKX2-5, GATA4, cTNT, cTNI, MEF2C, MLC2a, or any combination thereof. In some embodiments, the mature cardiomyocytes express NKX2-5, MEF2C or a com-bination thereof. In some embodiments, cardiac progenitor cells express early stage cardiac progenitor markers such as GATA4, ISL1 or a combination thereof.

In some embodiments, the gene product is a polynucle-otide. In some embodiments, as described below, the gene product is a guide RNA capable of binding to an RNA-guided endonuclease. In some embodiments, the gene prod-uct is an inhibitory nucleic acid capable of reducing the level of an mRNA and/or a polypeptide gene product, e.g., in a cardiac cell. For example, in some embodiments, the poly-nucleotide gene product is an interfering RNA capable of selectively inactivating a transcript encoded by an allele that causes a cardiac disease or disorder. As an example, the allele is a myosin heavy chain 7, cardiac muscle, beta (MYH7) allele that comprises a hypertrophic cardiomyopa-thy-causing mutation. Other examples include, e.g., inter-fering RNAs that selectively inactivate a transcript encoded by an allele that causes hypertrophic cardiomyopathy (HCM), dilated cardiomyopathy (DCM) or Left Ventricular Non-Compaction (LVNC), where the allele is a MYL3 (myosin light chain 3, alkali, ventricular, skeletal slow), MYH7, TNNI3 (troponin I type 3 (cardiac)), TNNT2 (tro-ponin T type 2 (cardiac)), TPM1 (tropomyosin 1 (alpha)) or ACTC1 allele comprising an HCM-causing, a DCM-causing or a LVNC-causing mutation. See. e.g., U.S. Pat. Pub. No. 2016/0237430 for examples of cardiac disease-causing mutations.

In some embodiments, the gene product is a polypeptide-encoding RNA. In some embodiments, the gene product is an interfering RNA. In some embodiments, the gene product is an aptamer. In some embodiments, the gene product is a polypeptide. In some embodiments, the gene product is a therapeutic polypeptide, e.g., a polypeptide that provides clinical benefit. In some embodiments, the gene product is a site-specific nuclease that provide for site-specific knock-down of gene function. In some embodiments, the gene product is an RNA-guided endonuclease that provides for modification of a target nucleic acid. In some embodiments, the gene products are: i) an RNA-guided endonuclease that provides for modification of a target nucleic acid; and ii) a guide RNA that comprises a first segment that binds to a target sequence in a target nucleic acid and a second segment that binds to the RNA-guided endonuclease. In some embodiments, the gene products are: i) an RNA-guided endonuclease that provides for modification of a target nucleic acid; ii) a first guide RNA that comprises a first segment that binds to a first target sequence in a target nucleic acid and a second segment that binds to the RNA-guided endonuclease; and iii) a first guide RNA that com-prises a first segment that binds to a second target sequence in the target nucleic acid and a second segment that binds to the RNA-guided endonuclease.

A nucleotide sequence encoding a heterologous gene product in an rAAV virion of the present disclosure can be operably linked to a promoter. For example, a nucleotide sequence encoding a heterologous gene product in an rAAV virion of the present disclosure can be operably linked to a constitutive promoter, a regulatable promoter, or a cardiac cell-specific promoter. Suitable constitutive promoters include a human elongation factor 1 α subunit (EF1α) promoter, a β-actin promoter, an α-actin promoter, a β-glucuronidase promoter, CAG promoter, super core promoter, and a ubiquitin promoter. In some embodiments, a nucleotide sequence encoding a heterologous gene product in an rAAV virion of the present disclosure is operably linked to a cardiac-specific transcriptional regulator element (TRE), where cardiac-specific TREs include promoters and enhancers. Suitable cardiac-specific TREs include, but are not limited to, TREs derived from the following genes: myosin light chain-2 (MLC-2), a-myosin heavy chain (a-MHC), desmin, AE3, cardiac troponin C (cTnC, and cardiac actin. Franz et al. (1997) *Cardiovasc. Res.* 35:560-566; Robbins et al. (1995) *Ann. NY. Acad. Sci.* 752:492-505; Linn et al. (1995) *Circ. Res.* 76:584-591; Parmacek et al. (1994)*Mol. Cell. Biol.* 14: 1870-1885; Hunter et al. (1993) *Hypertension* 22:608-617; and Sartorelli et al. (1992)*Proc. Natl. Acad. Sci. USA* 89:4047-4051. See also, Pacak et al. (2008) *Genet Vaccines Ther.* 6:13. In some embodiments, the promoter is an $\alpha$-MHC promoter, an MLC-2 promoter, or cTnT promoter.

The polynucleotide encoding a gene product is operably linked to a promoter and/or enhancer to facilitate expression of the gene product. Depending on the host/vector system utilized, any of a number of suitable transcription and translation control elements, including constitutive and inducible promoters, transcription enhancer elements, transcription terminators, etc. may be used in the rAAV virion (e.g., Bitter et al. (1987) *Methods in Enzymology,* 153:516-544).

Separate promoters and/or enhancers can be employed for each of the polynucleotides. In some embodiments, the same promoter and/or enhance is used for two or more polynucleotides in a single open reading frame. Vectors employing this configuration of genetic elements are termed "polycistronic." An illustrative example of a polycistronic vector comprises an enhancer and a promoter operatively linked to a single open-reading frame comprising two or more polynucleotides linked by 2A region(s), whereby expression of the open-reading frame result in multiple polypeptides being generated co-translationally. The 2A region is believed to mediate generation of multiple polypeptide sequences through codon skipping; however, the present disclosure relates also to polycistronic vectors that employ post-translational cleavage to generate two or more proteins of interest from the same polynucleotide. Illustrative 2A sequences, vectors, and associated methods are provided in US20040265955A1, which is incorporated herein by reference.

Non-limiting examples of suitable eukaryotic promoters (promoters functional in a eukaryotic cell) include CMV, CMV immediate early, HSV thymidine kinase, early and late SV40, long terminal repeats (LTRs) from retrovirus, and mouse metallothionein-I. In some embodiments, promoters that are capable of conferring cardiac specific expression will be used. Non-limiting examples of suitable cardiac specific promoters include desmin (Des), alpha-myosin heavy chain (a-MHC), myosin light chain 2 (MLC-2), cardiac troponin T (cTnT) and cardiac troponin C (cTnC). Non-limiting examples of suitable neuron specific promoters include synapsin I (SYN), calcium/calmodulin-dependent protein kinase II, tubulin alpha I, neuron-specific enolase and platelet-derived growth factor beta chain promoters and hybrid promoters by fusing cytomegalovirus enhancer (E) to those neuron-specific promoters.

Examples of suitable promoters for driving expression reprogramming factors include, but are not limited to, retroviral long terminal repeat (LTR) elements; constitutive promoters such as CMV, HSV1-TK, SV40, EF-1a, β-actin, phosphoglycerol kinase (PGK); inducible promoters, such as those containing Tet-operator elements; cardiac specific promoters, such as desmin (DES), alpha-myosin heavy chain (a-MHC), myosin light chain 2 (MLC-2), cardiac troponin T (cTnT) and cardiac troponin C (cTnC); neural specific promoters, such as nestin, neuronal nuclei (NeuN), microtubule-associate protein 2 (MAP2), beta III tubulin, neuron specific enolase (NSE), oligodendrocyte lineage (Oligl/2), and glial fibrillary acidic protein (GFAP); and pancreatic specific promoters, such as Pax4, Nkx2.2, Ngn3, insulin, glucagon, and somatostatin.

In some embodiments, a polynucleotide is operably linked to a cell type-specific transcriptional regulator element (TRE), where TREs include promoters and enhancers. Suitable TREs include, but are not limited to, TREs derived from the following genes: myosin light chain-2, a-myosin heavy chain, AE3, cardiac troponin C, and cardiac actin. Franz et al. (1997) *Cardiovasc. Res.* 35:560-566; Robbins et al. (1995) *Ann. N. Y. Acad. Sci.* 752:492-505; Linn et al. (1995) *Circ. Res.* 76:584-591; Parmacek et al. (1994) *Cell. Biol.* 14:1870-1885; Hunter et al. (1993) *Hypertension* 22:608-617; and Sartorelli et al. (1992) *PNAS USA* 89:4047-4051.

The promoter can be one naturally associated with a gene or nucleic acid segment. Similarly, for RNAs (e.g., microRNAs), the promoter can be one naturally associated with a microRNA gene (e.g., an miRNA-302 gene). Such a naturally associated promoter can be referred to as the "natural promoter" and may be obtained by isolating the 5' non-coding sequences located upstream of the coding segment and/or exon. Similarly, an enhancer may be one naturally associated with a nucleic acid sequence. However, the enhancer can be located either downstream or upstream of that sequence.

Alternatively, certain advantages will be gained by positioning the coding nucleic acid segment under the control of a recombinant or heterologous promoter, which refers to a promoter that is not normally associated with a nucleic acid in its natural environment. A recombinant or heterologous enhancer refers also to an enhancer not normally associated with a nucleic acid sequence in its natural environment. Such promoters or enhancers can include promoters or enhancers of other genes, and promoters or enhancers isolated from any other prokaryotic, viral, or eukaryotic cell, and promoters or enhancers not "naturally occurring," i.e., containing different elements of different transcriptional regulatory regions, and/or mutations that alter expression. In addition to producing nucleic acid sequences of promoters and enhancers synthetically, sequences may be produced using recombinant cloning and/or nucleic acid amplification technology, including PCR™, in connection with the compositions disclosed herein (see U.S. Pat. Nos. 4,683,202, 5,928,906, each incorporated herein by reference).

The promoters employed may be constitutive, inducible, developmentally-specific, tissue-specific, and/or useful under the appropriate conditions to direct high level expression of the nucleic acid segment. For example, the promoter can be a constitutive promoter such as, a CMV promoter, a CMV cytomegalovirus immediate early promoter, a CAG promoter, an EF-1α promoter, a HSV1-TK promoter, an SV40 promoter, a β-actin promoter, a PGK promoter, or a combination thereof. Examples of eukaryotic promoters that can be used include, but are not limited to, constitutive promoters, e.g., viral promoters such as CMV, SV40 and RSV promoters, as well as regulatable promoters, e.g., an inducible or repressible promoter such as the tet promoter, the hsp70 promoter and a synthetic promoter regulated by CRE. In certain embodiments, cell type-specific promoters are used to drive expression of reprogramming factors in specific cell types. Examples of suitable cell type-specific promoters useful for the methods described herein include, but are not limited to, the synthetic macrophage-specific promoter described in He et al (2006), *Human Gene Therapy* 17:949-959; the granulocyte and macrophage-specific lysozyme M promoter (see, e.g., Faust et al (2000), *Blood* 96(2):719-726); and the myeloid-specific CD11b promoter (see, e.g., Dziennis et al (1995), *Blood* 85(2):319-329). Other examples of promoters that can be employed include a human EF1α elongation factor promoter, a CMV cytomegalovirus immediate early promoter, a CAG chicken albumin promoter, a viral promoter associated with any of the viral vectors described herein, or a promoter that is homologous to any of the promoters described herein (e.g., from another species). Examples of prokaryotic promoters that can be used include, but are not limited to, SP6, T7, T5, tac, bla, trp, gal, lac, or maltose promoters.

In some embodiments, an internal ribosome entry sites (IRES) element can be used to create multigene, or polycistronic, messages. IRES elements are able to bypass the ribosome scanning model of 5'-methylated Cap dependent translation and begin translation at internal sites (Pelletier and Sonenberg, *Nature* 334(6180):320-325 (1988)). IRES elements from two members of the picornavirus family (polio and encephalomyocarditis) have been described (Pelletier and Sonenberg, *Nature* 334(6180):320-325 (1988)), as well an IRES from a mammalian message (Macejak & Samow, *Nature* 353:90-94 (1991)). IRES elements can be linked to heterologous open reading frames. Multiple open reading frames can be transcribed together, each separated by an IRES, creating polycistronic messages. By virtue of the IRES element, each open reading frame is accessible to ribosomes for efficient translation. Multiple genes can be efficiently expressed using a single promoter/enhancer to transcribe a single message (see U.S. Pat. Nos. 5,925,565 and 5,935,819, herein incorporated by reference).

In some embodiments, a nucleotide sequence is operably linked to a polyadenylation sequence. Suitable polyadenylation sequences include bovine growth hormone polyA signal (bGHpolyA) and short poly A signal. Optionally the rAAV vectors of the disclosure comprise the Woodchuck Post-transcriptional Regulatory Element (WPRE). In some embodiments, the polynucleotide encoding gene products are join by sequences include so-called self-cleaving peptide, e.g. P2A peptides.

In some embodiments, the gene product comprises a site-specific endonuclease that provides for site-specific knock-down of gene function, e.g., where the endonuclease knocks out an allele associated with a cardiac disease or disorder. For example, where a dominant allele encodes a defective copy of a gene that, when wild-type, is a cardiac structural protein and/or provides for normal cardiac function, a site-specific endonuclease can be targeted to the defective allele and knock out the defective allele. In some embodiments, a site-specific endonuclease is an RNA-guided endonuclease.

In addition to knocking out a defective allele, a site-specific nuclease can also be used to stimulate homologous recombination with a donor DNA that encodes a functional copy of the protein encoded by the defective allele. For example, a subject rAAV virion can be used to deliver both a site-specific endonuclease that knocks out a defective allele a functional copy of the defective allele (or fragment thereof), resulting in repair of the defective allele, thereby providing for production of a functional cardiac protein (e.g., functional troponin, etc.). In some embodiments, a subject rAAV virion comprises a heterologous nucleotide sequence that encodes a site-specific endonuclease and a heterologous nucleotide sequence that encodes a functional copy of a defective allele, where the functional copy encodes a functional cardiac protein. Functional cardiac proteins include, e.g., troponin, a chloride ion channel, and the like.

Site-specific endonucleases that are suitable for use include, e.g., zinc finger nucleases (ZFNs); meganucleases; and transcription activator-like effector nucleases (TAL-ENs), where such site-specific endonucleases are non-naturally occurring and are modified to target a specific gene. Such site-specific nucleases can be engineered to cut specific locations within a genome, and non-homologous end joining can then repair the break while inserting or deleting several nucleotides. Such site-specific endonucleases (also referred to as "INDELs") then throw the protein out of frame and effectively knock out the gene. See. e.g., U.S. Pat. Pub. No. 2011/0301073. Suitable site-specific endonucleases include engineered meganuclease re-engineered homing endonucleases. Suitable endonucleases include an I-TevI nuclease. Suitable meganucleases include I-Scel (see, e.g., Bellaiche et al. (1999) *Genetics* 152: 1037); and I-Crel (see, e.g., Heath et al. (1997) *Nature Sructural Biology* 4:468). Site-specific endonucleases that are suitable for use include CRISPRi systems and the Cas9-based SAM system.

In some embodiments, the gene product is an RNA-guided endonuclease. In some embodiments, the gene product comprises an RNA comprising a nucleotide sequence encoding an RNA-guided endonuclease. In some embodiments, the gene product is a guide RNA, e.g., a single-guide RNA. In some embodiments, the gene products are: 1) a guide RNA; and 2) an RNA-guided endonuclease. The guide RNA can comprise: a) a protein-binding region that binds to the RNA-guided endonuclease; and b) a region that binds to a target nucleic acid. An RNA-guided endonuclease is also referred to herein as a "genome editing nuclease."

Examples of suitable genome editing nucleases are CRISPR/Cas endonucleases (e.g., class 2 CRISPR/Cas endonucleases such as a type II, type V, or type VI CRISPR/Cas endonucleases). A suitable genome editing nuclease is a CRISPR/Cas endonuclease (e.g., a class 2 CRISPR/Cas endonuclease such as a type II, type V, or type VI CRISPR/Cas endonuclease). In some embodiments, the gene product comprises a class 2 CRISPR/Cas endonuclease. In some embodiments, the gene product comprises a class 2 type II CRISPR/Cas endonuclease (e.g., a Cas9 protein). In some embodiments, the gene product comprises a class 2 type V CRISPR/Cas endonuclease (e.g., a Cpf1 protein, a C2c1 protein, or a C2c3 protein). In some embodiments, the gene product comprises a class 2 type VI CRISPR/Cas endonuclease (e.g., a C2c2 protein; also referred to as a "Casl3a" protein). In some embodiments, the gene product comprises a CasX protein. In some embodiments, the gene product comprises a CasY protein.

Methods of Use

In some embodiments, the disclosure provides methods of identifying AAV capsid proteins that confer on rAAV virions increased transduction efficiency in target cells. The methods comprise providing a population of rAAV virions whose rAAV genomes comprise a library of cap polynucleotides encoding variant AAV capsid proteins; optionally contacting the population with non-target cells for a time sufficient to permit attachment of undesired rAAV virions to the non-target cells; contacting the population with target cells for a time sufficient to permit transduction of the cap polynucleotide into the target cells by the rAAV virions; and sequencing the cap polynucleotides from the target cells, thereby identifying AAV capsid proteins that confer increased transduction efficiency in the target cells. In some embodiments, the method further comprises depleting the population of rAAV virions by contacting the population with non-target cells for time sufficient to permit attachment of the rAAV virions to the non-target cells. Non-limiting examples of such identifications methods are provided in the Examples.

The disclosure provides methods for generating cardiomyocytes and/or cardiomyocyte-like cells in vitro using an rAAV virion. Selected starting cells are transduced with an rAAV and optionally exposed to small-molecule reprogramming factors (before, during, or after transduction) for a time and under conditions sufficient to convert the starting cells across lineage and/or differentiation boundaries to form cardiac progenitor cells and/or cardiomyocytes. In some embodiments, the starting cells are fibroblast cells. In some embodiments, the starting cells express one or more markers indicative of a differentiated phenotype. The time for conversion of starting cells into cardiac progenitor and cardiomyocyte cells can vary. For example, the starting cells can be incubated after treatment with one or more polynucleotides or proteins of interest until cardiac or cardiomyocyte cell markers are expressed. Such cardiac or cardiomyocyte cell markers can include any of the following markers: α-GATA4, TNNT2, MYH6, RYR2, NKX2-5, MEF2C, ANP, Actinin, MLC2v, MY20, cMHC, ISL1, cTNT, cTNI, and MLC2a, or any combination thereof. In some embodiments, the induced cardiomycocyte cells are negative for one or more neuronal cells markers. Such neuronal cell markers can include any of the following markers: DCX, TUBB3, MAP2, and ENO2.

Incubation can proceed until cardiac progenitor markers are expressed by the starting cells. Such cardiac progenitor markers include GATA4, TNNT2, MYH6, RYR2, or a combination thereof. The cardiac progenitor markers such as GATA4, TNNT2, MYH6, RYR2, or a combination thereof can be expressed by about 8 days, or by about 9 days, or by about 10 days, or by about 11 days, or by about 12 days, or by about 14 days, or by about 15 days, or by about 16 days, or by about 17 days, or by about 18 days, or by about 19 days, or by about 20 days after starting incubation of cells in the compositions described herein. Further incubation of the cells can be performed until expression of late stage cardiac progenitor markers such as NKX2-5, MEF2C or a combination thereof occurs.

Reprogramming efficiency may be measured as a function of cardiomyocyte markers. Such pluripotency markers include, but are not limited to, the expression of cardiomyocyte marker proteins and mRNA, cardiomyocyte morphology and electrophysiological phenotype. Non-limiting examples of cardiomyocyte markers include, a-sarcoglycan, atrial natriuretic peptide (ANP), bone morphogenetic protein 4 (BMP4), connexin 37, connexin 40, crypto, desmin, GATA4, GATA6, MEF2C, MYH6, myosin heavy chain, NKX2.5, TBX5, and Troponin T.

The expression of various markers specific to cardiomyocytes may be detected by conventional biochemical or immunochemical methods (e.g., enzyme-linked immunosorbent assay, immunohistochemical assay, and the like). Alternatively, expression of a nucleic acid encoding a cardiomyocyte-specific marker can be assessed. Expression of cardiomyocyte-specific marker-encoding nucleic acids in a cell can be confirmed by reverse transcriptase polymerase chain reaction (RT-PCR) or hybridization analysis, molecular biological methods which have been commonly used in the past for amplifying, detecting and analyzing mRNA coding for any marker proteins. Nucleic acid sequences coding for markers specific to cardiomyocytes are known and are available through public databases such as GenBank. Thus, marker-specific sequences needed for use as primers or probes are easily determined.

Cardiomyocytes exhibit some cardiac-specific electrophysiological properties. One electrical characteristic is an action potential, which is a short-lasting event in which the difference of potential between the interior and the exterior of each cardiac cell rises and falls following a consistent trajectory. Another electrophysiological characteristic of cardiomyocytes is the cyclic variations in the cytosolic-free $Ca^{2+}$ concentration, named as $Ca^{2+}$ transients, which are employed in the regulation of the contraction and relaxation of cardiomyocytes. These characteristics can be detected and evaluated to assess whether a population of cells has been reprogrammed into cardiomyocytes.

The present disclosure provides a method of delivering a gene product to a cardiac cell, e.g., a cardiac fibroblast. The methods generally involve infecting a cardiac cell (e.g., a cardiac fibroblast) with an rAAV virion, where the gene product(s) encoded by the heterologous nucleic acid present in the rAAV virion is/are produced in the cardiac cell (e.g., cardiac fibroblast). Delivery of gene product(s) to a cardiac cell (e.g., cardiac fibroblast) can provide for treatment of a cardiac disease or disorder. Delivery of gene product(s) to a cardiac cell (e.g., cardiac fibroblast) can provide for generation of an induced cardiomyocyte-like (iCM) cell from the cardiac fibroblast. Delivery of gene product(s) to a cardiac cell (e.g., cardiac fibroblast) can provide for editing of the genome of the cardiac cell (e.g., cardiac fibroblast).

In some embodiments, infecting or transducing a cardiac cell (e.g., cardiac fibroblast) is carried out in vitro. In some embodiments, infecting or transducing a cardiac cell (e.g., cardiac fibroblast) is carried out in vitro; and the infected/transduced cardiac cell (e.g., cardiac fibroblast) is introduced into (e.g., transfused into or implanted into) an individual in need thereof, e.g., directly into cardiac tissue of an individual in need thereof. For in vitro transduction, an effective amount of rAAV virions to be delivered to cells is from about $10^5$ to about $10^{13}$ of the rAAV virions. Other effective dosages can be readily established by one of ordinary skill in the art through routine trials establishing dose response curves.

In some embodiments, infecting a cardiac cell (e.g., cardiac fibroblast) is carried out in vivo. For example, in some embodiments, an effective amount of an rAAV virion of the present disclosure is administered directly into cardiac tissue of an individual in need thereof. An "effective amount" will fall in a relatively broad range that can be determined through experimentation and/or clinical trials. For example, for in vivo injection, i.e., injection directly into cardiac tissue, a therapeutically effective dose will be on the order of from about $10^6$ to about $10^5$ of the rAAV virions, e.g., from about $10^5$ to $10^{12}$ rAAV virions, of the present disclosure. In some embodiments, an effective amount of an rAAV virion of the present disclosure is administered via intramyocardial injection through the epicardium. In some embodiments, an effective amount of an rAAV virion of the present disclosure is administered via vascular delivery through the coronary artery. In some embodiments, an effective amount of an rAAV virion of the present disclosure is administered via systemic delivery through the superior vena cava. In some embodiments, an effective amount of an rAAV virion of the present disclosure is administered via systemic delivery through a peripheral vein.

For example, from about $10^4$ to about $10^5$, from about $10^5$ to about $10^6$, from about $10^6$ to about $10^7$, from about $10^6$ to about $10^7$, from about $10^7$ to about $10^8$, from about $10^8$ to about $10^9$, from about $10^9$ to about $10^{10}$, from about $10^{10}$ to about $10^{11}$, to about $10^{11}$, from about $10^{11}$ to about $10^{12}$, from about $10^{12}$ to about $10^{13}$, from about $10^{13}$ to about $10^{14}$, from about $10^{14}$ to about $10^{15}$ genome copies, or more than $10^{15}$ genome copies, of an rAAV virion of the present disclosure are administered to an individual, e.g., are administered directly into cardiac tissue in the individual, or are administered via another route. The number of rAAV virions administered to an individual can be expressed in viral genomes (vg) per kilogram (kg) body weight of the individual. In some embodiments, and effective amount of an rAAV virion of the present disclosure is from about $10^2$ vg/kg to $10^4$ vg/kg, from about $10^4$ vg/kg to about $10^6$ vg/kg, from about $10^6$ vg/kg to about $10^8$ vg/kg, from about $10^8$ vg/kg to about $10^{10}$ vg/kg, from about $10^{10}$ vg/kg to about $10^{12}$ vg/kg, from about $10^{12}$ vg/kg to about $10^{14}$ vg/kg, from about $10^{14}$ vg/kg to about $10^{16}$ vg/kg, from about $10^{16}$ vg/kg to about $10^{18}$ vg/kg, or more than $10^{18}$ vg/kg.

In some embodiments, an effective amount of an rAAV virion of the present disclosure is administered via intramyocardial injection through the epicardium. In some embodiments, an effective amount of an rAAV virion of the present disclosure is administered via vascular delivery through the coronary artery. In some embodiments, an effective amount of an rAAV virion of the present disclosure is administered via systemic delivery through the superior vena cava. In some embodiments, an effective amount of an rAAV virion of the present disclosure is administered via systemic delivery through a peripheral vein.

In some embodiments, more than one administration (e.g., two, three, four or more administrations) may be employed to achieve the desired level of gene expression. In some embodiments, the more than one administration is administered at various intervals, e.g., daily, weekly, twice monthly, monthly, every 3 months, every 6 months, yearly, etc. In some embodiments, multiple administrations are administered over a period of time of from 1 month to 2 months, from 2 months to 4 months, from 4 months to 8 months, from 8 months to 12 months, from 1 year to 2 years, from 2 years to 5 years, or more than 5 years.

The present disclosure provides a method of reprogramming a cardiac fibroblast to generate an induced cardiomyocyte-like cell (iCM). The method generally involves infecting a cardiac fibroblast with an rAAV virion of the present disclosure, where the rAAV virion comprises a heterologous nucleic acid comprising a nucleotide sequence encoding one or more reprogramming factors.

The expression of various markers specific to cardiomyocytes is detected by conventional biochemical or immunochemical methods (e.g., enzyme-linked immunosorbent assay; immunohistochemical assay; and the like). Alternatively, expression of nucleic acid encoding a cardiomyocyte-specific marker can be assessed. Expression of cardiomyocyte-specific marker-encoding nucleic acids in a cell can be confirmed by reverse transcriptase polymerase chain reaction (RT-PCR) or hybridization analysis, molecular biological methods which have been commonly used in the past for amplifying, detecting and analyzing mRNA coding for any marker proteins. Nucleic acid sequences coding for markers specific to cardiomyocytes are known and are available through public data bases such as GenBank; thus, marker-specific sequences needed for use as primers or probes is easily determined.

Induced cardiomyocytes can also exhibit spontaneous contraction. Whether an induced cardiomyocyte exhibits spontaneous contraction can be determined using standard electrophysiological methods (e.g., patch clamp).

In some embodiments, induced cardiomyocytes can exhibit spontaneous $Ca^{2+}$ oscillations. $Ca^{2+}$ oscillations can be detected using standard methods, e.g., using any of a variety of calcium-sensitive dyes, intracellular $Ca^{2+}$ ion-detecting dyes include, but are not limited to, fura-2, bis-fura 2, indo-1, Quin-2, Quin-2 AM, Benzothiaza-1, Benzothiaza-2, indo-5F, Fura-FF, BTC, Mag-Fura-2, Mag-Fura-5, Mag-Indo-1, fluo-3, rhod-2, rhod-3, fura-4F, fura-5F, fura-6F, fluo-4, fluo-5F, fluo-5N, Oregon Green 488 BAPTA, Calcium Green, Calcein, Fura-C18, Calcium Green-C18, Calcium Orange, Calcium Crimson, Calcium Green-5N, Magnesium Green, Oregon Green 488 BAPTA-1, Oregon Green 488 BAPTA-2, X-rhod-1, Fura Red, Rhod-5F, Rhod-5N, X-Rhod-5N, Mag-Rhod-2, Mag-X-Rhod-1, Fluo-5N, Fluo-5F, Fluo-4FF, Mag-Fluo-4, Aequorin, dextran conjugates or any other derivatives of any of these dyes, and others (see, e.g., the catalog or Internet site for Molecular Probes, Eugene, see, also, Nuccitelli, ed., Methods in Cell Biology, Volume 40: A Practical Guide to the Study of Calcium in Living Cells, Academic Press (1994); Lambert, ed., Calcium Signaling Protocols (Methods in Molecular Biology Volume 114), Humana Press (1999); W. T. Mason, ed., Fluorescent and Luminescent Probes for Biological Activity. A Practical Guide to Technology for Quantitative Real-Time Analysis, Second Ed, Academic Press (1999); Calcium Signaling Protocols (Methods in Molecular Biology), 2005, D. G. Lamber, ed., Humana Press.).

In some embodiments, an iCM is generated in vitro; and the iCM is introduced into an individual, e.g., the iCM is implanted into a cardiac tissue of an individual in need thereof. A method of the present disclosure can comprise infecting a population of cardiac fibroblasts in vitro, to generate a population of iCMs; and the population of iCMs is implanted into a cardiac tissue of an individual in need thereof.

In some embodiments, an iCM is generated in vivo. For example, in some embodiments, an rAAV virion of the present disclosure that comprises a heterologous nucleic acid comprising a nucleotide sequence encoding one or more reprogramming factors is administered to an individual. In some embodiments, the rAAV virion is administered directly into cardiac tissue of an individual in need thereof. In some embodiments, from about $10^6$ to about $10^5$, from about $10^5$ to about $10^9$, from about $10^9$ to about $10^{10}$, from about $10^{10}$ to about $10^{11}$, from about $10^{11}$ to about $10^{12}$, from about $10^{12}$ to about $10^{13}$, from about $10^{13}$ to about $10^{14}$, from about $10^{14}$ to about $10^{15}$ genome copies, or more than $10^{15}$ genome copies, of an rAAV virion of the present disclosure that comprises a heterologous nucleic acid comprising a nucleotide sequence encoding one or more reprogramming factors are administered to an individual, e.g., are administered directly into cardiac tissue in the individual or via another route of administration. The number of rAAV virions administered to an individual can be expressed in viral genomes (vg) per kilogram (kg) body weight of the individual. In some embodiments, and effective amount of an rAAV virion of the present disclosure is from about $10^2$ vg/kg to $10^4$ vg/kg, from about $10^4$ vg/kg to about $10^6$ vg/kg, from about $10^6$ vg/kg to about $10^8$ vg/kg, from about $10^8$ vg/kg to about $10^{10}$ vg/kg, from about $10^{10}$ vg/kg to about $10^{12}$ vg/kg, from about $10^{12}$ vg/kg to about $10^{14}$ vg/kg, from about $10^{14}$ vg/kg to about $10^{14}$ vg/kg, from about $10^{14}$ vg/kg to about $10^{16}$ vg/kg, or more than $10^{16}$ vg/kg. In some embodiments, an effective amount of an rAAV virion of the present disclosure is administered via intramyocardial injection through the epicardium. In some embodiments, an effective amount of an rAAV virion of the present disclosure is administered via vascular delivery through the coronary artery. In some embodiments, an effective amount of an rAAV virion of the present disclosure is administered via systemic delivery through the superior vena cava. In some embodiments, an effective amount of an rAAV virion of the present disclosure is administered via systemic delivery through a peripheral vein.

The present disclosure provides a method of modifying ("editing") the genome of a cardiac cell. The present disclosure provides a method of modifying ("editing") the genome of a cardiac fibroblast. The present disclosure provides a method of modifying ("editing") the genome of a cardiomyocyte. The methods generally involve infecting a cardiac cell (e.g., a cardiac fibroblast or a cardiomyocyte) with an rAAV virion of the present disclosure, where the rAAV virion comprises a heterologous nucleic acid comprising a nucleotide sequence encoding a genome-editing endonuclease. In some embodiments, the method comprises infecting a cardiac fibroblast or a cardiomyocyte with an rAAV virion of the present disclosure, where the rAAV virion comprises a heterologous nucleic acid comprising a nucleotide sequence encoding an RNA-guided genome-editing endonuclease. In some embodiments, the method comprises infecting a cardiac fibroblast or a cardiomyocyte with an rAAV virion of the present disclosure, where the rAAV virion comprises a heterologous nucleic acid comprising a nucleotide sequence encoding: i) an RNA-guided genome-editing endonuclease; and ii) one or more guide RNAs.

In some embodiments, the method comprises infecting a cardiac fibroblast or a cardiomyocyte with an rAAV virion of the present disclosure, where the rAAV virion comprises a heterologous nucleic acid comprising a nucleotide sequence encoding: i) an RNA-guided genome-editing endonuclease; ii) a guide RNAs; and iii) a donor template DNA. Suitable RNA-guided genome-editing endonucleases are described above.

In some embodiments, infecting a cardiac cell (e.g., cardiac fibroblast; a cardiomyocyte) is carried out in vitro. In some embodiments, infecting a cardiac cell (e.g., cardiac fibroblast; a cardiomyocyte) is carried out in vitro; and the infected cardiac cell (e.g., cardiac fibroblast) is introduced into (e.g., implanted into) an individual in need thereof, e.g., directly into cardiac tissue of an individual in need thereof. For in vitro transduction, an effective amount of rAAV virions to be delivered to cells will be on the order of from about $10^5$, to about $10^{13}$ of the rAAV virions. Other effective dosages can be readily established by one of ordinary skill in the art through routine trials establishing dose response curves.

In some embodiments, infecting a cardiac cell (e.g., cardiac fibroblast; a cardiomyocyte) is carried out in vivo. For example, in some embodiments, an effective amount of an rAAV virion of the present disclosure is administered directly into cardiac tissue of an individual in need thereof. An "effective amount" will fall in a relatively broad range that can be determined through experimentation and/or clinical trials. For example, for in vivo injection, i.e., injection directly into cardiac tissue, a therapeutically effective dose will be on the order of from about $10^6$ to about $10^{15}$ of the rAAV virions, e.g., from about $10^{11}$ to $10^{12}$ rAAV virions, of the present disclosure. In some embodiments, an effective amount of an rAAV virion of the present disclosure is administered via intramyocardial injection through the epicardium. In some embodiments, an effective amount of an rAAV virion of the present disclosure is administered via vascular delivery through the coronary artery. In some embodiments, an effective amount of an rAAV virion of the present disclosure is administered via systemic delivery through the superior vena cava. In some embodiments, an effective amount of an rAAV virion of the present disclosure is administered via systemic delivery through a peripheral vein.

For example, from about $10^6$ to about $10^7$, from about $10^7$ to about $10^8$, from about $10^8$ to about $10^9$, from about $10^9$ to about $10^{10}$, from about $10^{10}$ to about $10^{11}$, from about $10^{11}$ to about $10^{12}$, from about $10^{12}$ to about $10^{13}$, from about $10^{13}$ to about $10^{14}$, from about $10^{14}$ to about $10^{15}$ genome copies, or more than $10^{15}$ genome copies, of an rAAV virion of the present disclosure are administered to an individual, e.g., are administered directly into cardiac tissue in the individual. The number of rAAV virions administered to an individual can be expressed in viral genomes (vg) per kilogram (kg) body weight of the individual. In some embodiments, and effective amount of an rAAV virion of the present disclosure is from about $10^2$ vg/kg to $10^4$ vg/kg, from about $10^4$ vg/kg to about $10^6$ vg/kg, from about $10^6$ vg/kg to about $10^8$ vg/kg, from about $10^8$ vg/kg to about $10^{10}$ vg/kg, from about $10^{10}$ vg/kg to about $10^{12}$ vg/kg, from about $10^{12}$ vg/kg to about $10^{14}$ vg/kg, from about $10^{14}$ vg/kg to about $10^{16}$ vg/kg, from about $10^{16}$ vg/kg to about $10^{18}$ vg/kg, or more than $10^{18}$ vg/kg. In some embodiments, an effective amount of an rAAV virion of the present disclosure is administered via intramyocardial injection through the epicardium. In some embodiments, an effective amount of an rAAV virion of the present disclosure is administered via vascular delivery through the coronary artery. In some embodiments, an effective amount of an rAAV virion of the present disclosure is administered via systemic delivery through the superior vena cava. In some embodiments, an effective amount of an rAAV virion of the present disclosure is administered via systemic delivery through a peripheral vein.

In some embodiments, the genome editing comprises homology-directed repair (HDR). In some embodiments, the HDR corrects a defect in an endogenous target nucleic acid in the cardiac fibroblast or the cardiomyocyte, where the defect is associated with, or leads to, a defect in structure and/or function of the cardiac fibroblast or the cardiomyocyte, or a component of the cardiac fibroblast or the cardiomyocyte.

In some embodiments, the genome editing comprises non-homologous end joining (NHEJ). In some embodiments, the NHEJ deletes a defect in an endogenous target nucleic acid in the cardiac fibroblast or the cardiomyocyte, where the defect is associated with, or leads to, a defect in structure and/or function of the cardiac fibroblast or the cardiomyocyte, or a component of the cardiac fibroblast or the cardiomyocyte.

A method of the present disclosure for editing the genome of a cardiac cell can be used to correct any of a variety of genetic defects that give rise to a cardiac disease or disorder. Mutations of interest include mutations in one or more of the following genes: cardiac troponin T (TNNT2); myosin heavy chain (MYH7); tropomyosin 1 (TPM1); myosin binding protein C (MYBPC3); 5'-AMP-activated protein kinase subunit gamma-2 (PRKAG2); troponin I type 3 (TNNI3); titin (TTN); myosin, light chain 2 (MYL2); actin, alpha cardiac muscle 1 (ACTC1); potassium voltage-gated channel, KQT-like subfamily, member 1 (KCNQ1); plakophilin 2 (PKP2); myocyte enhancer factor 2c (MEF2C); and cardiac LIM protein (CSRP3). Specific mutations of interest include, without limitation, MYH7 R663H mutation; TNNT2 R173W; PKP2 2013delC mutation; PKP2 Q617X mutation; and KCNQ1 G269S missense mutation. Mutations of interest include mutations in one or more of the following genes: MYH6, ACTN2, SERCA2, GATA4, TBX5, MYOCD, NKX2-5, NOTCH1, MEF2C, HAND2, and HAND1. In some embodiments, the mutations of interest include mutations in the following genes: MEF2C, TBX5, and MYOCD. Cardiac diseases and disorders that can be treated with a method of the present disclosure include coronary heart disease, cardiomyopathy, endocarditis, congenital cardiovascular defects, and congestive heart failure. Cardiac diseases and disorders that can be treated with a method of the present disclosure include hypertrophic cardiomyopathy; a valvular heart disease; myocardial infarction; congestive heart failure; long QT syndrome; atrial arrhythmia; ventricular arrhythmia; diastolic heart failure; systolic heart failure; cardiac valve disease; cardiac valve calcification; left ventricular non-compaction; ventricular septal defect; and ischemia.

Methods of Treatment

The disclosure provides a methods of treating a cardiac pathology in a subject in need thereof, comprising administering a therapeutically effective amount of a pharmaceutical composition comprising an rAAV virion to the subject, wherein the rAAV virion transduces cardiac tissue.

Subjects in need of treatment using compositions and methods of the present disclosure include, but are not limited to, individuals having a congenital heart defect, individuals suffering from a degenerative muscle disease, individuals suffering from a condition that results in ischemic heart tissue (e.g., individuals with coronary artery disease), and the like. In some examples, a method is useful to treat a degenerative muscle disease or condition (e.g., familial cardiomyopathy, dilated cardiomyopathy, hypertrophic cardiomyopathy, restrictive cardiomyopathy, or coronary artery disease with resultant ischemic cardiomyopathy). In some examples, a subject method is useful to treat individuals having a cardiac or cardiovascular disease or disorder, for example, cardiovascular disease, aneurysm, angina, arrhythmia, atherosclerosis, cerebrovascular accident (stroke), cerebrovascular disease, congenital heart disease, congestive heart failure, myocarditis, valve disease coronary, artery disease dilated, diastolic dysfunction, endocarditis, high blood pressure (hypertension), cardiomyopathy, hypertrophic cardiomyopathy, restrictive cardiomyopathy, coronary artery disease with resultant ischemic cardiomyopathy, mitral valve prolapse, myocardial infarction (heart attack), or venous thromboembolism.

Subjects suitable for treatment using the compositions, cells and methods of the present disclosure include individuals (e.g., mammalian subjects, such as humans, non-human primates, domestic mammals, experimental non-human mammalian subjects such as mice, rats, etc.) having a cardiac condition including but limited to a condition that results in ischemic heart tissue (e.g., individuals with coronary artery disease) and the like.

In some examples, an individual suitable for treatment suffers from a cardiac or cardiovascular disease or condition, e.g., cardiovascular disease, aneurysm, angina, arrhythmia, atherosclerosis, cerebrovascular accident (stroke), cerebrovascular disease, congenital heart disease, congestive heart failure, myocarditis, valve disease coronary, artery disease dilated, diastolic dysfunction, endocarditis, high blood pressure (hypertension), cardiomyopathy, hypertrophic cardiomyopathy, restrictive cardiomyopathy, coronary artery disease with resultant ischemic cardiomyopathy, mitral valve prolapse, myocardial infarction (heart attack), or venous thromboembolism. In some examples, individuals suitable for treatment with a subject method include individuals who have a degenerative muscle disease, e.g., familial cardiomyopathy, dilated cardiomyopathy, hypertrophic cardiomyopathy, restrictive cardiomyopathy, or coronary artery disease with resultant ischemic cardiomyopathy.

For example, the cardiac pathology can be selected from the group consisting of congestive heart failure, myocardial infarction, cardiac ischemia, myocarditis and arrhythmia. In some embodiments, the subject is diabetic. In some embodiments, the subject is non-diabetic. In some embodiments, the subject suffers from diabetic cardiomyopathy.

For therapy, the rAAV virions of the disclosure and/or pharmaceutical compositions thereof can be administered locally or systemically. An rAAV virion can be introduced by injection, catheter, implantable device, or the like. An rAAV virion can be administered in any physiologically acceptable excipient or carrier that does not adversely affect the cells. For example, rAAV virions of the disclosure and/or pharmaceutical compositions thereof can be administered intravenously or through an intracardiac route (e.g., epicardially or intramyocardially). Methods of administering rAAV virions of the disclosure and/or pharmaceutical compositions thereof to subjects, particularly human subjects include injection or infusion of the pharmaceutical compositions (e.g., compositions comprising rAAV virions). Injection may include direct muscle injection and infusion may include intravascular infusion. The rAAV virions or pharmaceutical compositions can be inserted into a delivery device which facilitates introduction by injection into the subjects. Such delivery devices include tubes, e.g., catheters, for injecting cells and fluids into the body of a recipient subject. The tubes can additionally include a needle, e.g., a syringe, through which the cells of the invention can be introduced into the subject at a desired location.

In some embodiments, the rAAV virion is administered by subcutaneous, intravenous, intramuscular, intraperitoneal, or intracardiac injection or by intracardiac catheterization. In some embodiments, the rAAV virion is administered by direct intramyocardial injection or transvascular administration. In some embodiments, the rAAV virion is administered by direct intramyocardial injection, antegrade intracoronary injection, retrograde injection, transendomyocardial injection, or molecular cardiac surgery with recirculating delivery (MCARD).

The rAAV virions can be inserted into such a delivery device, e.g., a syringe, in different forms. The rAAV virion can be supplied in the form of a pharmaceutical composition. Such a composition can include an isotonic excipient prepared under sufficiently sterile conditions for human administration. For general principles in medicinal formulation, the reader is referred to *Cell Therapy: Stem Cell Transplantation, Gene Therapy, and Cellular Immunotherapy*, by G. Morstyn & W. Sheridan eds, Cambridge University Press, 1996; and *Hematopoietic Stem Cell Therapy*, E. D. Ball, J. Lister & P. Law, Churchill Livingstone, 2000. The choice of the excipient and any accompanying constituents of the composition can be adapted to optimize administration by the route and/or device employed.

Recombinant AAV may be administered locally or systemically. Recombinant AAV may be engineered to target specific cell types by selecting the appropriate capsid protein of the disclosure. To determine the suitability of various therapeutic administration regimens and dosages of AAV virion compositions, the rAAV virionscan first be tested in a suitable animal model. At one level, recombinant AAV are assessed for their ability to infect target cells in vivo. Recombinant AAV can also be assessed to ascertain whether it migrates to target tissues, whether they induce an immune response in the host, or to determine an appropriate number, or dosage, of rAAV virions to be administered. It may be desirable or undesirable for the recombinant AAV to generate an immune response, depending on the disease to be treated. Generally, if repeated administration of a virion is required, it will be advantageous if the virion is not immunogenic. For testing purposes, rAAV virion compositions can be administered to immunodeficient animals (such as nude mice, or animals rendered immunodeficient chemically or by irradiation). Target tissues or cells can be harvested after a period of infection and assessed to determine if the tissues or cells have been infected and if the desired phenotype (e.g. induced cardiomyocyte) has been induced in the target tissue or cells.

Recombinant AAV virions can be administered by various routes, including without limitation direct injection into the heart or cardiac catetherization. Alternatively, the rAAV virions can be administered systemically such as by intravenous infusion. When direct injection is used, it may be performed either by open-heart surgery or by minimally invasive surgery. In some embodiments, the recombinant viruses are delivered to the pericardial space by injection or infusion. Injected or infused recombinant viruses can be traced by a variety of methods. For example, recombinant AAV labeled with or expressing a detectable label (such as green fluorescent protein, or beta-galactosidase) can readily be detected. The recombinant AAV may be engineered to cause the target cell to express a marker protein, such as a surface-expressed protein or a fluorescent protein. Alternatively, the infection of target cells with recombinant AAV can be detected by their expression of a cell marker that is not expressed by the animal employed for testing (for example, a human-specific antigen when injecting cells into an experimental animal). The presence and phenotype of the target cells can be assessed by fluorescence microscopy (e.g., for green fluorescent protein, or beta-galactosidase), by immunohistochemistry (e.g., using an antibody against a human antigen), by ELISA (using an antibody against a human antigen), or by RT-PCR analysis using primers and hybridization conditions that cause amplification to be specific for RNA indicative of a cardiac phenotype.

Pharmaceutical Compostions

The present disclosure provides pharmaceutical composition comprising an rAAV virion of the disclosure. The pharmaceutical composition may include one or more of a pharmaceutically acceptable carrier, diluent, excipient, and buffer. In some embodiments, the pharmaceutically acceptable carrier, diluent, excipient, or buffer is suitable for use in a human. Such excipients, carriers, diluents, and buffers include any pharmaceutical agent that can be administered without undue toxicity. Pharmaceutically acceptable excipients include, but are not limited to, liquids such as water, saline, glycerol and ethanol. Pharmaceutically acceptable salts can be included therein, for example, mineral acid salts such as hydrochlorides, hydrobromides, phosphates, sulfates, and the like; and the salts of organic acids such as acetates, propionates, malonates, benzoates, and the like. Additionally, auxiliary substances, such as pH buffering substances may be present in such vehicles. A wide variety of pharmaceutically acceptable excipients are known in the art and need not be discussed in detail herein. Pharmaceutically acceptable excipients have been amply described in a variety of publications, including, for example, A. Gennaro (2000) *Remington: The Science and Practice of Pharmacy,* 20th edition, Lippincott, Williams, & Wilkins; Pharmaceutical Dosage Forms and Drug Delivery Systems (1999) H. C. Ansel et al., eds., $7^{th}$ ed., Lippincott, Williams, & Wilkins; and *Handbook of Pharmaceutical Excipients* (2000) A. H. Kibbe et al., eds., $3^{rd}$ ed. Amer. Pharmaceutical Assoc.

To prepare the composition, rAAV virion is generated and purified as necessary or desired. The rAAV can be mixed with or suspended in a pharmaceutically acceptable carrier.

These rAAV can be adjusted to an appropriate concentration, and optionally combined with other agents. The concentration of rAAV virion and/or other agent included in a unit dose can vary widely. The dose and the number of administrations can be optimized by those skilled in the art. For example, about $10^2$-$10^{10}$ vector genomes (vg) may be administered. In some embodiments, the dose be at least about $10^2$ vg, about $10^3$ vg, about $10^4$ vg, about $10^5$ vg, about $10^6$ vg, about $10^7$ vg, about $10^8$ vg, about $10^9$ vg, about $10^{10}$ vg, or more vector genomes. Daily doses of the compounds can vary as well. Such daily doses can range, for example, from at least about $10^2$ vg/day, about $10^3$ vg/day, about $10^4$ vg/day, to about $10^5$ vg/day, about $10^6$ vg/day, about $10^7$ vg/day, about $10^8$ vg/day, about $10^9$ vg/day, about $10^{10}$ vg/day, or more vector genomes per day.

In certain embodiments, the method of treatment is enhanced by the administration of one or more anti-inflammatory agents, e.g., an anti-inflammatory steroid or a non-steroidal antiinflammatory drug (NSAID).

Anti-inflammatory steroids for use in the invention include the corticosteroids, and in particular those with glucocorticoid activity, e.g., dexamethasone and prednisone. Nonsteroidal anti-inflammatory drugs (NSAIDs) for use in the invention generally act by blocking the production of prostaglandins that cause inflammation and pain, cyclooxygenase-1 (COX-1) and/or cyclooxygenase-2 (COX-2). Traditional NSAIDs work by blocking both COX-1 and COX-2. The COX-2 selective inhibitors block only the COX-2 enzyme. In certain embodiment, the NSAID is a COX-2 selective inhibitor, e.g., celecoxib (Celebrex®), rofecoxib (Vioxx), and valdecoxib (B extra). In certain embodiments, the anti-inflammatory is an NSAID prostaglandin inhibitor, e.g., Piroxicam.

The amount of rAAV virion for use in treatment will vary not only with the particular carrier selected but also with the route of administration, the nature of the condition being treated and the age and condition of the patient. Ultimately, the attendant health care provider may determine proper dosage. A pharmaceutical composition may be formulated with the appropriate ratio of each compound in a single unit dosage form for administration with or without cells. Cells or vectors can be separately provided and either mixed with a liquid solution of the compound composition, or administered separately.

Recombinant AAV can be formulated for parenteral administration (e.g., by injection, for example, bolus injection or continuous infusion) and may be presented in unit dosage form in ampoules, prefilled syringes, small volume infusion containers or multi-dose containers with an added preservative. The pharmaceutical compositions can take the form of suspensions, solutions, or emulsions in oily or aqueous vehicles, and can contain formulatory agents such as suspending, stabilizing and/or dispersing agents. Suitable carriers include saline solution, phosphate buffered saline, and other materials commonly used in the art.

The compositions can also contain other ingredients such as agents useful for treatment of cardiac diseases, conditions and injuries, such as, for example, an anticoagulant (e.g., dalteparin (fragmin), danaparoid (organan), enoxaparin (lovenox), heparin, tinzaparin (innohep), and/or warfarin (coumadin)), an antiplatelet agent (e.g., aspirin, ticlopidine, clopidogrel, or dipyridamole), an angiotensin-converting enzyme inhibitor (e.g., Benazepril (Lotensin), Captopril (Capoten), Enalapril (Vasotec), Fosinopril (Monopril), Lisinopril (Prinivil, Zestril), Moexipril (Univasc), Perindopril (Aceon), Quinapril (Accupril), Ramipril (Altace), and/or Trandolapril (Mavik)), angiotensin II receptor blockers (e.g., Candesartan (Atacand), Eprosartan (Teveten), Irbesartan (Avapro), Losartan (Cozaar), Telmisartan (Micardis), and/or Valsartan (Diovan)), a beta blocker (e.g., Acebutolol (Sectral), Atenolol (Tenormin), Betaxolol (Kerlone), Bisoprolol/hydrochlorothiazide (Ziac), Bisoprolol (Zebeta), Carteolol (Cartrol), Metoprolol (Lopressor, Toprol XL), Nadolol (Corgard), Propranolol (Inderal), Sotalol (Betapace), and/or Timolol (Blocadren)), Calcium Channel Blockers (e.g., Amlodipine (Norvasc, Lotrel), Bepridil (Vascor), Diltiazem (Cardizem, Tiazac), Felodipine (Plendil), Nifedipine (Adalat, Procardia), Nimodipine (Nimotop), Nisoldipine (Sular), Verapamil (Calan, Isoptin, Verelan), diuretics (e.g, Amiloride (Midamor), Bumetanide (Bumex), Chlorothiazide (Diuril), Chlorthalidone (Hygroton), Furosemide (Lasix), Hydrochlorothiazide (Esidrix, Hydrodiuril), Indapamide (Lozol) and/or Spironolactone (Aldactone)), vasodilators (e.g., Isosorbide dinitrate (Isordil), Nesiritide (Natrecor), Hydralazine (Apresoline), Nitrates and/or Minoxidil), statins, nicotinic acid, gemfibrozil, clofibrate, Digoxin, Digitoxin, Lanoxin, or any combination thereof.

Additional agents can also be included such as antibacterial agents, antimicrobial agents, anti-viral agents, biological response modifiers, growth factors; immune modulators, monoclonal antibodies and/or preservatives. The compositions of the invention may also be used in conjunction with other forms of therapy.

The rAAV virions described herein can be administered to a subject to treat a disease or disorder. Such a composition may be in a single dose, in multiple doses, in a continuous or intermittent manner, depending, for example, upon the recipient's physiological condition, whether the purpose of the administration is in response to traumatic injury or for more sustained therapeutic purposes, and other factors known to skilled practitioners. The administration of the compounds and compositions of the invention may be essentially continuous over a preselected period of time or may be in a series of spaced doses. Both local and systemic administration is contemplated. In some embodiments, localized delivery of rAAV virion is achieved. In some embodiments, localized delivery of rAAV virions is used to generate a population of cells within the heart. In some embodiments, such a localized population operates as "pacemaker cells" for the heart. In some embodiments, the rAAV virions are used to generate, regenerate, repair, replace, and/or rejunevate one or more of a sinoatrial (SA) node, an atrioventricular (AV) node, a bindle of His, and/or Purkinje fibres.

To control tonicity, an aqueous pharmaceutical composition can comprise a physiological salt, such as a sodium salt. Sodium chloride (NaCl) is preferred, which may be present at between 1 and 20 mg/ml. Other salts that may be present include potassium chloride, potassium dihydrogen phosphate, disodium phosphate dehydrate, magnesium chloride and calcium chloride.

Compositions may include one or more buffers. Typical buffers include: a phosphate buffer; a Tris buffer; a borate buffer; a succinate buffer; a histidine buffer; or a citrate buffer. Buffers will typically be included at a concentration in the 5-20 mM range. The pH of a composition will generally be between 5 and 8, and more typically between 6 and 8 e.g. between 6.5 and 7.5, or between 7.0 and 7.8.

The composition is preferably sterile. The composition is preferably gluten free. The composition is preferably non-pyrogenic.

In some embodiments, a composition comprising cells may include a cryoprotectant agent. Non-limiting examples of cryoprotectant agents include a glycol (e.g., ethylene glycol, propylene glycol, and glycerol), dimethyl sulfoxide (DMSO), formamide, sucrose, trehalose, dextrose, and any combinations thereof.

One or more of the following types of compounds can also be present in the composition with the rAAV virions: a WNT agonist, a GSK3 inhibitor, a TGF-beta signaling inhibitor, an epigenetic modifier, LSD1 inhibitor, an adenylyl cyclase agonist, or any combination thereof.

Kits

A variety of kits are described herein that include any of composition (e.g. rAAV virions) described herein. The kit can include any of compositions described herein, either mixed together or individually packaged, and in dry or hydrated form. The rAAV virions and/or other agents described herein can be packaged separately into discrete vials, bottles or other containers. Alternatively, any of the rAAV virions and/or agents described herein can be packaged together as a single composition, or as two or more compositions that can be used together or separately. The compounds and/or agents described herein can be packaged in appropriate ratios and/or amounts to facilitate conversion of selected cells across differentiation boundaries to form cardiac progenitor cells and/or cardiomyocytes.

The kit can include instructions for administering those compositions, compounds and/or agents. Such instructions can provide the information described throughout this application. The rAAV virion or pharmaceutical composition can be provided within any of the kits in the form of a delivery device. Alternatively a delivery device can be separately included in the kits, and the instructions can describe how to assemble the delivery device prior to administration to a subject.

Any of the kits can also include syringes, catheters, scalpels, sterile containers for sample or cell collection, diluents, pharmaceutically acceptable carriers, and the like. The kits can provide other factors such as any of the supplementary factors or drugs described herein for the compositions in the preceding section or other parts of the application.

Numbered Embodiments

Embodiment I-1. A recombinant adeno-associated virus (rAAV) virion, comprising:
  a) an AAV5 capsid protein, wherein the capsid protein comprises an insertion with respect to a parental sequence of 5 to 11 amino acids at an insertion site in the GH loop of the parental sequence; and
  b) a heterologous nucleic acid comprising a nucleotide sequence encoding a gene product.

Embodiment I-2. The rAAV virion of embodiment I-1, wherein the rAAV virion exhibits increased transduction efficiency in cardiac cells compared to an AAV virion comprising the parental sequence.

Embodiment I-3. The rAAV virion of embodiment I-1, wherein the rAAV virion exhibits increased transduction efficiency in human cardiac fibroblast (hCF) cells compared to an AAV virion comprising the parental sequence.

Embodiment I-4. The rAAV virion of embodiment I-3, wherein the rAAV virion exhibits at least 10-fold increased transduction efficiency in hCF cells at a multiplicity of infection (MOI) of 1,000.

Embodiment I-5. The rAAV virion of embodiment I-3, wherein the rAAV virion exhibits at least 2-fold increased transduction efficiency in hCF cells at a multiplicity of infection (MOI) of 100,000.

Embodiment I-6. The rAAV virion of embodiment I-1, wherein the rAAV virion exhibits increased transduction efficiency in induced pluripotent stem cell-derived cardio-myocyte (iPS-CM) cells compared to an AAV virion comprising the parental sequence.

Embodiment I-7. The rAAV virion of embodiment I-6, wherein the rAAV virion exhibits at least 2-fold increased transduction efficiency in iPS-CM cells at a multiplicity of infection (MOI) of 100,000.

Embodiment I-8. The rAAV virion of embodiment I-6, wherein the rAAV virion exhibits at least 4-fold increased transduction efficiency in iPS-CM cells at a multiplicity of infection (MOI) of 1,000.

Embodiment I-9. The rAAV virion of embodiment I-1, wherein the rAAV virion exhibits increased selectivity of the rAAV virion for hCF cells over iPS-CM cells.

Embodiment I-10. The rAAV virion of embodiment I-1, wherein the rAAV virion exhibits increased selectivity of the rAAV virion for iPS-CM cells over hCF cells.

Embodiment I-11. The rAAV virion of embodiment I-1, wherein the insertion site is between any two, optionally adjacent, amino acids at positions in the parental sequence corresponding to 560 to 594 of SEQ ID NO: 1.

Embodiment I-12. The rAAV virion of embodiment I-11, wherein the insertion site is between adjacent amino acids in the parental sequence corresponding to 574 and 575 of SEQ ID NO: 1.

Embodiment I-13. The rAAV virion of embodiment I-12, wherein the insertion is a peptide of formula:

$$-X_0-(X)_n-X_{10}-$$

wherein n is 5-9, and wherein $X_0$ and $X_{10}$ are each independently A, S, G, or absent (SEQ ID NO: 1101).

Embodiment I-14. The rAAV virion of embodiment I-12, wherein the insertion is a peptide of formula:

$$-X_0-X_1-X_2-X_3-X_4-X_5-X_6-X_7-X_8-$$

wherein $X_0$ and $X_8$ are each independently A, S, G, or absent (SEQ ID NO: 1102).

Embodiment I-15. The rAAV virion of embodiment I-12, wherein the insertion is a peptide of formula:

$$-A-X_1-X_2-X_3-X_4-X_5-X_6-X_7-A-$$

wherein:

a) $X_1$ is P, R, or G;

b) $X_2$ is K, L, or R;

c) $X_3$ is any amino acid;

d) $X_4$ is N, H, K, or Q;

e) $X_5$ is any amino acid, or optionally $X_5$ is G, K, or S;

f) $X_6$ is any amino acid, or optionally $X_6$ is T or V; and g) $X_7$ is any amino acid, or optionally $X_7$ is K or V (SEQ ID NO: 1103).

Embodiment I-Embodiment I-16. The rAAV virion of embodiment I-14, wherein the insertion comprises an amino acid sequence selected from SEQ ID NOs: 101-600.

Embodiment I-17. The rAAV virion of embodiment I-14, wherein the insertion comprises an amino acid sequence selected from RKVHIEV (SEQ ID NO: 81), RKYQSDL (SEQ ID NO: 82), PLTNTVK (SEQ ID NO: 83), LKYHGPP (SEQ ID NO: 84), RKYQGDM (SEQ ID NO: 85), RKFHSTD (SEQ ID NO: 86), RKHHGLE (SEQ ID NO: 87), PGTNVTK (SEQ ID NO: 88), RKMHMPD (SEQ ID NO: 89), PLKKIVQ (SEQ ID NO: 90), PLGKKTS (SEQ ID NO: 91), PRGVKVT (SEQ ID NO: 92), PLAKSKS (SEQ ID NO: 93), PRTKGAV (SEQ ID NO: 94), and PSGRKAT (SEQ ID NO: 95).

Embodiment I-18. The rAAV virion of embodiment I-14, wherein the insertion comprises an amino acid sequence selected from ARKVHIEVA (SEQ ID NO: 101), ARKYQSDLA (SEQ ID NO: 102), APLTNTVKA (SEQ ID NO: 103), ALKYHGPPA (SEQ ID NO: 104), ARKYQGDMA (SEQ ID NO: 105), ARKFHSTDA (SEQ ID NO: 106), ARKHHGLEA (SEQ ID NO: 107), APGTNVTKA (SEQ ID NO: 108), ARKMHMPDA (SEQ ID NO: 109), APLKKIVQA (SEQ ID NO: 110), APLGKKTSA (SEQ ID NO: 111), APRGVKVTA (SEQ ID NO: 112), APLAKSKSA (SEQ ID NO: 113), APRTKGAVA (SEQ ID NO: 114), APSGRKATA (SEQ ID NO: 115).

Embodiment I-19. The rAAV virion of embodiment I-14, wherein the insertion comprises the amino acid sequence PLTNTVK (SEQ ID NO: 83) or a sequence comprising at most 1, 2, 3, or 4 amino-acid substitutions relative to PLTNTVK (SEQ ID NO: 83).

Embodiment I-20. The rAAV virion of embodiment I-14, wherein the insertion comprises the amino acid sequence PLKKIVQ (SEQ ID NO: 90) or a sequence comprising at most 1, 2, 3, or 4 amino-acid substitutions relative to PLKKIVQ (SEQ ID NO: 90).

Embodiment I-21. An AAV5 capsid protein, wherein the capsid protein comprises an insertion with respect to a parental sequence of 5 to 11 amino acids at an insertion site in the GH loop of the parental sequence.

Embodiment I-22. The AAV5 capsid protein of embodiment I-21, wherein the AAV5 capsid protein exhibits increased transduction efficiency in cardiac cells compared to an AAV virion comprising the parental sequence.

Embodiment I-23. The AAV5 capsid protein of embodiment I-21, wherein the AAV5 capsid protein exhibits increased transduction efficiency in human cardiac fibroblast (hCF) cells compared to an AAV virion comprising the parental sequence.

Embodiment I-24. The AAV5 capsid protein of embodiment I-23, wherein the AAV5 capsid protein exhibits at least 10-fold increased transduction efficiency in hCF cells at a multiplicity of infection (MOI) of 1,000.

Embodiment I-25. The AAV5 capsid protein of embodiment I-23, wherein The AAV5 capsid protein exhibits at least 2-fold increased transduction efficiency in hCF cells at a multiplicity of infection (MOI) of 100,000.

Embodiment I-26. The AAV5 capsid protein of embodiment I-21, wherein the AAV5 capsid protein exhibits increased transduction efficiency in induced pluripotent stem cell-derived cardiomyocyte (iPS-CM) cells compared to an AAV virion comprising the parental sequence.

Embodiment I-27. The AAV5 capsid protein of embodiment I-26, wherein the AAV5 capsid protein exhibits at least 2-fold increased transduction efficiency in iPS-CM cells at a multiplicity of infection (MOI) of 100,000.

Embodiment I-28. The AAV5 capsid protein of embodiment I-26, wherein the AAV5 capsid protein exhibits at least 4-fold increased transduction efficiency in iPS-CM cells at a multiplicity of infection (MOI) of 1,000.

Embodiment I-29. The AAV5 capsid protein of embodiment I-21, wherein the AAV5 capsid protein exhibits increased selectivity of The AAV5 capsid protein for hCF cells over iPS-CM cells.

Embodiment I-30. The AAV5 capsid protein of embodiment I-21, wherein the AAV5 capsid protein exhibits increased selectivity of The AAV5 capsid protein for iPS-CM cells over hCF cells.

Embodiment I-31. The AAV5 capsid protein of embodiment I-21, wherein the insertion site is between any two, optionally adjacent, amino acids at positions in the parental sequence corresponding to 560 to 594 of SEQ ID NO: 1.

Embodiment I-32. The AAV5 capsid protein of embodiment I-21, wherein the insertion site is between adjacent amino acids in the parental sequence corresponding to 574 and 575 of SEQ ID NO: 1.

Embodiment I-33. The AAV5 capsid protein of embodiment I-32, wherein the insertion is a peptide of formula:

$$-X_0-(X)_n-X_{10}-$$

wherein n is 5-9, and
wherein $X_0$ and $X_{10}$ are each independently A, S, G, or absent (SEQ ID NO: 1101).

Embodiment I-34. The AAV5 capsid protein of embodiment I-32, wherein the insertion is a peptide of formula:

$$-X_0-X_1-X_2-X_3-X_4-X_5-X_6-X_7-X_8-$$

wherein $X_0$ and $X_8$ are each independently A, S, G, or absent (SEQ ID NO: 1102).

Embodiment I-35. The AAV5 capsid protein of embodiment I-32, wherein the insertion is a peptide of formula:

$$-A-X_1-X_2-X_3-X_4-X_5-X_6-X_7-A-$$

wherein:
a) $X_1$ is P, R, or G;
b) $X_2$ is K, L, or R;
c) $X_3$ is any amino acid;
d) $X_4$ is N, H, K, or Q;
e) $X_5$ is any amino acid, or optionally $X_5$ is G, K, or S;
f) $X_6$ is any amino acid, or optionally $X_6$ is T or V; and
g) $X_7$ is any amino acid, or optionally $X_7$ is K or V (SEQ ID NO: 1103).

Embodiment I-36. The AAV5 capsid protein of embodiment I-34, wherein the insertion comprises an amino acid sequence selected from SEQ ID NOs: 101-600.

Embodiment I-37. The AAV5 capsid protein of embodiment I-34, wherein the insertion comprises an amino acid sequence selected from RKVHIEV (SEQ ID NO: 81), RKYQSDL (SEQ ID NO: 82), PLTNTVK (SEQ ID NO: 83), LKYHGPP (SEQ ID NO: 84), RKYQGDM (SEQ ID NO: 85), RKFHSTD (SEQ ID NO: 86), RKHHGLE (SEQ ID NO: 87), PGTNVTK (SEQ ID NO: 88), RKMHMPD (SEQ ID NO: 89), PLKKIVQ (SEQ ID NO: 90), PLGKKTS (SEQ ID NO: 91), PRGVKVT (SEQ ID NO: 92), PLAK-SKS (SEQ ID NO: 93), PRTKGAV (SEQ ID NO: 94), and PSGRKAT (SEQ ID NO: 95).

Embodiment I-38. The AAV5 capsid protein of embodiment I-34, wherein the insertion comprises an amino acid sequence selected from ARKVHIEVA (SEQ ID NO: 101), ARKYQSDLA (SEQ ID NO: 102), APLTNTVKA (SEQ ID NO: 103), ALKYHGPPA (SEQ ID NO: 104), ARKYQGDMA (SEQ ID NO: 105), ARKFHSTDA (SEQ ID NO: 106), ARKHHGLEA (SEQ ID NO: 107), APGTNVTKA (SEQ ID NO: 108), ARKMHMPDA (SEQ ID NO: 109), APLKKIVQA (SEQ ID NO: 110), APLGKKTSA (SEQ ID NO: 111), APRGVKVTA (SEQ ID NO: 112), APLAKSKSA (SEQ ID NO: 113), APRTKGAVA (SEQ ID NO: 114), APSGRKATA (SEQ ID NO: 115).

Embodiment I-39. The AAV5 capsid protein of embodiment I-34, wherein the insertion comprises the amino acid sequence PLTNTVK (SEQ ID NO: 83) or a sequence comprising at most 1, 2, 3, or 4 amino-acid substitutions relative to PLTNTVK (SEQ ID NO: 83).

Embodiment I-40. The AAV5 capsid protein of embodiment I-34, wherein the insertion comprises the amino acid sequence PLKKIVQ (SEQ ID NO: 90) or a sequence comprising at most 1, 2, 3, or 4 amino-acid substitutions relative to PLKKIVQ (SEQ ID NO: 90).

Embodiment I-41. A polynucleotide encoding the AAV5 capsid protein of any one of embodiments I-21 to I-40.

Embodiment I-42. A pharmaceutical composition comprising the rAAV virion of any one of embodiments I-1 to I-20.

Embodiment I-43. A method of transducing a cardiac cell, comprising contacting the cardiac cell with an rAAV virion according to any one of embodiments I-1 to I-20, wherein the rAAV virion transduces the cardiac cell.

Embodiment I-44. A method of delivering one or more gene products to a cardiac cell, comprising contacting the cardiac cell with an rAAV virion according to any one of embodiments I-1 to I-20, wherein the cardiac cell expresses the gene product.

Embodiment I-45. The method of embodiment I-44, wherein the one or more gene products comprise a short-hairpin RNA or a microRNA.

Embodiment I-46. The method of embodiment I-44, wherein the one or more gene products comprising a guide RNA, a Cas protein, and optionally a repair template, wherein the gene products form a functional a CRISPR/Cas system.

Embodiment I-47. The method of embodiment I-44, wherein the one or more gene products comprise a polypeptide.

Embodiment I-48. The method of embodiment I-47, wherein the polypeptide is selected from cardiac troponin T; a cardiac sarcomeric protein; β-myosin heavy chain; myosin ventricular essential light chain 1; myosin ventricular regulatory light chain 2; cardiac α-actin; a-tropomyosin; cardiac troponin I; cardiac myosin binding protein C; four-and-a-half LIM protein 1; titin; 5-AMP-activated protein kinase subunit gamma-2; troponin I type 3, myosin light chain 2, actin alpha cardiac muscle 1; cardiac LIM protein; caveolin 3 (CAV3); galactosidase alpha (GLA); lysosomal-associated membrane protein 2 (LAMP2); mitochondrial transfer RNA glycine (MTTG); mitochondrial transfer RNA isoleucine (MTTI); mitochondrial transfer RNA lysine (MTTK); mitochondrial transfer RNA glutamine (MTTQ); myosin light chain 3 (MYL3); troponin C (TNNC1); transthyretin (TTR); sarcoendoplasmic reticulum calcium-ATPase 2a (SERCA2a); stromal-derived factor-1 (SDF-1); adenylate cyclase-6 (AC6); β-ARKct (β-adrenergic receptor kinase C terminus); fibroblast growth factor (FGF); platelet-derived growth factor (PDGF); vascular endothelial growth factor (VEGF); hepatocyte growth factor; hypoxia inducible growth factor; thymosin beta 4 (TMSB4X); nitric oxide synthase-3 (NOS3); apoplipoprotein-E (ApoE); and superoxide dismutase (SOD); S100A1

Embodiment I-49. The method of embodiment I-44, wherein the one or more gene products comprise one or more reprogramming factors.

Embodiment I-50. The method of embodiment I-49, wherein the one or more reprogramming factors is one or more polypeptide selected from ASCL1, MYOCD, MEF2C, TBX5, CCNB1, CCND1, CDK1, CDK4, AURKB, OCT4, BAF60C, ESRRG, GATA4, GATA6, HAND2, IRX4, ISLL, MESP1, MESP2, NKX2.5, SRF, TBX20, and ZFPM2.

Embodiment I-51. The method of any one of embodiments I-43 to I-50, wherein the method reprograms the cardiac cell into a cardiac cardiomyocyte.

Embodiment I-52. A method of treating a cardiac pathology in a subject in need thereof, comprising administering a therapeutically effective amount of a pharmaceutical composition according to embodiment I-42 to the subject, wherein the rAAV virion transduces cardiac tissue.

Embodiment I-53. The method of embodiment I-52, wherein the rAAV virion is administered by subcutaneous, intravenous, epicardial, intramuscular, intraperitoneal, or intracardiac injection or by intracardiac catheterization.

Embodiment I-54. The method of embodiment I-52, wherein the rAAV virion is administered by direct intramyocardial injection or transvascular administration.

Embodiment I-55. The method of embodiment I-52, wherein the rAAV virion is administered by direct intramyocardial injection, antegrade intracoronary injection, retrograde injection, transendomyocardial injection, or molecular cardiac surgery with recirculating delivery (MCARD).

Embodiment I-56. A method of identifying AAV capsid proteins that confer on rAAV virions increased transduction efficiency in target cells, comprising:

a) providing a population of rAAV virions whose rAAV genomes comprise a library of cap polynucleotides encoding variant AAV capsid proteins;

b) contacting the population with target cells for a time sufficient to permit transduction of the cap polynucleotide into the target cells by the rAAV virions; and c) sequencing the cap polynucleotides from the target cells, thereby identifying AAV capsid proteins that confer increased transduction efficiency in the target cells.

Embodiment I-57. The method of embodiment I-56, further comprising, before step (b), depleting the population of rAAV virions by contacting the population with non-target cells for time sufficient to permit attachment of the rAAV virions to the non-target cells.

Embodiment I-58. A recombinant adeno-associated virus (rAAV) virion, comprising:

a) an AAV5 capsid protein, wherein the capsid protein comprises one or more substitutions selected from S651A, T578A, or T582A compared to a parental AAV5 capsid; and b) a heterologous nucleic acid comprising a nucleotide sequence encoding a gene product.

Embodiment I-59. The rAAV virion of embodiment I-58, wherein the AAV5 capsid protein comprises two or more substitutions selected from S651A, T578A, or T582A.

Embodiment I-60. The rAAV virion of embodiment I-58, wherein the AAV5 capsid protein comprises T582A and S651A substitutions.

Embodiment I-61. The rAAV virion of embodiment I-58, wherein the AAV5 capsid protein comprises T578A and T582A substitutions.

Embodiment I-62. The rAAV virion of embodiment I-58, wherein the AAV5 capsid protein comprises T578A and S651A substitutions.

Embodiment I-63. The rAAV virion of embodiment I-58, wherein the AAV5 capsid protein comprises S651A, T578A, and T582A substitutions.

Embodiment I-64. The rAAV virion of any one of embodiments I-58 to I-62, wherein the AAV5 capid protein shares at least 95% identity to SEQ ID NO: 73.

Embodiment I-65. The rAAV virion of any one of embodiments I-58 to I-62, wherein the AAV5 capid protein shares at least 98% identity to SEQ ID NO: 73.

Embodiment I-66. The rAAV virion of any one of embodiments I-58 to I-62, wherein the AAV5 capid protein shares at least 99% identity to SEQ ID NO: 73.

Embodiment I-67. The rAAV virion of any one of embodiments I-58 to I-62, wherein the AAV5 capid protein comprises the polypeptide sequence SEQ ID NO: 73.

Embodiment I-68. An AAV5 capsid protein comprising one or more substitutions selected from S651A, T578A, or T582A compared to a parental AAV5 capsid.

Embodiment I-69. The AAV5 capsid protein of embodiment I-67, wherein the capsid protein comprises two or more substitutions selected from S651A, T578A, or T582A.

Embodiment I-70. The AAV5 capsid protein of embodiment I-67, wherein the capsid protein comprises T582A and S651A substitutions.

Embodiment I-71. The AAV5 capsid protein of embodiment I-68, wherein the capsid protein comprises T578A and T582A substitutions.

Embodiment I-72. The AAV5 capsid protein of embodiment I-68, wherein the capsid protein comprises T578A and S651A substitutions.

Embodiment I-73. The AAV5 capsid protein of embodiment I-68, wherein the capsid protein comprises S651A, T578A, and T582A substitutions.

Embodiment I-74. The AAV5 capsid protein of any one of embodiments I-68 to I-73, wherein the capid protein shares at least 90% identity to SEQ ID NO: 73.

Embodiment I-75. The AAV5 capsid protein of any one of embodiments I-68 to I-73, wherein the capid protein shares at least 95% identity to SEQ ID NO: 73.

Embodiment I-76. The AAV5 capsid protein of any one of embodiments I-68 to I-73, wherein the capid protein shares at least 98% identity to SEQ ID NO: 73.

Embodiment I-77. The AAV5 capsid protein of any one of embodiments I-68 to I-73, wherein the capid protein shares at least 99% identity to SEQ ID NO: 73.

Embodiment I-78. A polynucleotide encoding the AAV5 capsid protein of any one of embodiments I-68 to I-77.

Embodiment I-79. A pharmaceutical composition comprising the rAAV virion of any one of embodiments I-58 to I-67.

Embodiment I-80. A method of transducing a cardiac cell, comprising contacting the cardiac cell with an rAAV virion according to any one of embodiments I-58 to I-67, wherein the rAAV virion transduces the cardiac cell.

Embodiment I-81. A method of delivering one or more gene products to a cardiac cell, comprising contacting the cardiac cell with an rAAV virion according to any one of embodiments I-58 to I-67, wherein the cardiac cell expresses the gene product.

Embodiment I-82. The method of embodiment I-81, wherein the one or more gene products comprise a short-hairpin RNA or a microRNA.

Embodiment I-83. The method of embodiment I-81, wherein the one or more gene products comprising a guide RNA, a Cas protein, and optionally a repair template, wherein the gene products form a functional a CRISPR/Cas system.

Embodiment I-84. The method of embodiment I-81, wherein the one or more gene products comprise a polypeptide.

Embodiment I-85. The method of embodiment I-84, wherein the polypeptide is selected from cardiac troponin T; a cardiac sarcomeric protein; β-myosin heavy chain; myosin ventricular essential light chain 1; myosin ventricular regulatory light chain 2; cardiac α-actin; a-tropomyosin; cardiac troponin I; cardiac myosin binding protein C; four-and-a-half LIM protein 1; titin; 5-AMP-activated protein kinase subunit gamma-2; troponin I type 3, myosin light chain 2, actin alpha cardiac muscle 1; cardiac LIM protein; caveolin 3 (CAV3); galactosidase alpha (GLA); lysosomal-associated membrane protein 2 (LAMP2); mitochondrial transfer RNA glycine (MTTG); mitochondrial transfer RNA isoleucine (MTTI); mitochondrial transfer RNA lysine (MTTK); mitochondrial transfer RNA glutamine (MTTQ); myosin light chain 3 (MYL3); troponin C (TNNC1); transthyretin (TTR); sarcoendoplasmic reticulum calcium-ATPase 2a (SERCA2a); stromal-derived factor-1 (SDF-1); adenylate cyclase-6 (AC6); β-ARKct (β-adrenergic receptor kinase C terminus); fibroblast growth factor (FGF); platelet-derived growth factor (PDGF); vascular endothelial growth factor (VEGF); hepatocyte growth factor; hypoxia inducible growth factor; thymosin beta 4 (TMSB4X); nitric oxide synthase-3 (NOS3); apoplipoprotein-E (ApoE); and superoxide dismutase (SOD); S100A1

Embodiment I-86. The method of embodiment I-81, wherein the one or more gene products comprise one or more reprogramming factors.

Embodiment I-87. The method of embodiment I-86, wherein the one or more reprogramming factors is one or more polypeptide selected from ASCL1, MYOCD, MEF2C, TBX5, CCNB1, CCND1, CDK1, CDK4, AURKB, OCT4, BAF60C, ESRRG, GATA4, GATA6, HAND2, IRX4, ISLL, MESP1, MESP2, NKX2.5, SRF, TBX20, and ZFPM2.

Embodiment I-88. The method of any one of embodiments I-80 to I-87, wherein the method reprograms the cardiac cell into a cardiac cardiomyocyte.

Embodiment I-89. A method of treating a cardiac pathology in a subject in need thereof, comprising administering a therapeutically effective amount of a pharmaceutical composition according to embodiment I-79 to the subject, wherein the rAAV virion transduces cardiac tissue.

Embodiment I-89. The method of embodiment I-89, wherein the rAAV virion is administered by subcutaneous, epicardial, intravenous, intramuscular, intraperitoneal, or intracardiac injection or by intracardiac catheterization.

Embodiment I-90. The method of embodiment I-89, wherein the rAAV virion is administered by direct intramyocardial injection or transvascular administration.

Embodiment I-91. The method of embodiment I-89, wherein the rAAV virion is administered by direct intramyocardial injection, antegrade intracoronary injection, retrograde injection, transendomyocardial injection, or molecular cardiac surgery with recirculating delivery (MCARD).

The following non-limiting Examples illustrate some of the experimental work involved in developing the invention.

EXAMPLES

Example 1: Identification of Capsid Protein Sequences

Library Generation and AAV Selection

Figure 1:
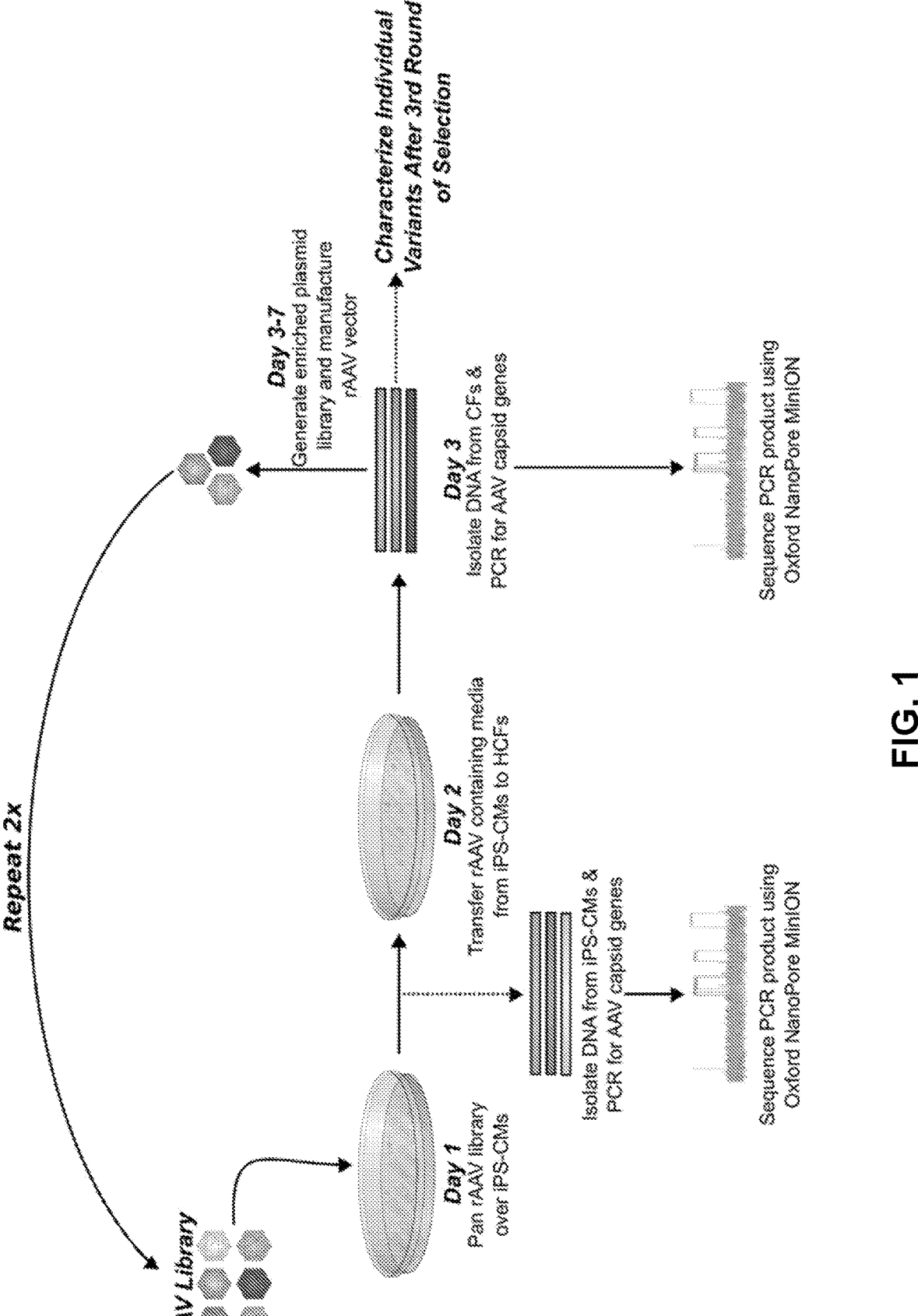
FIG. 1 shows an embodiment of a library screening strategy incorporating an initial negative selection step on induced pluripotent stem cell-derived cardiomyocytes (iPSC-CMs) followed by a positive selection step on human cardiac fibroblasts (hCFs).
Figures 2A, 2B:
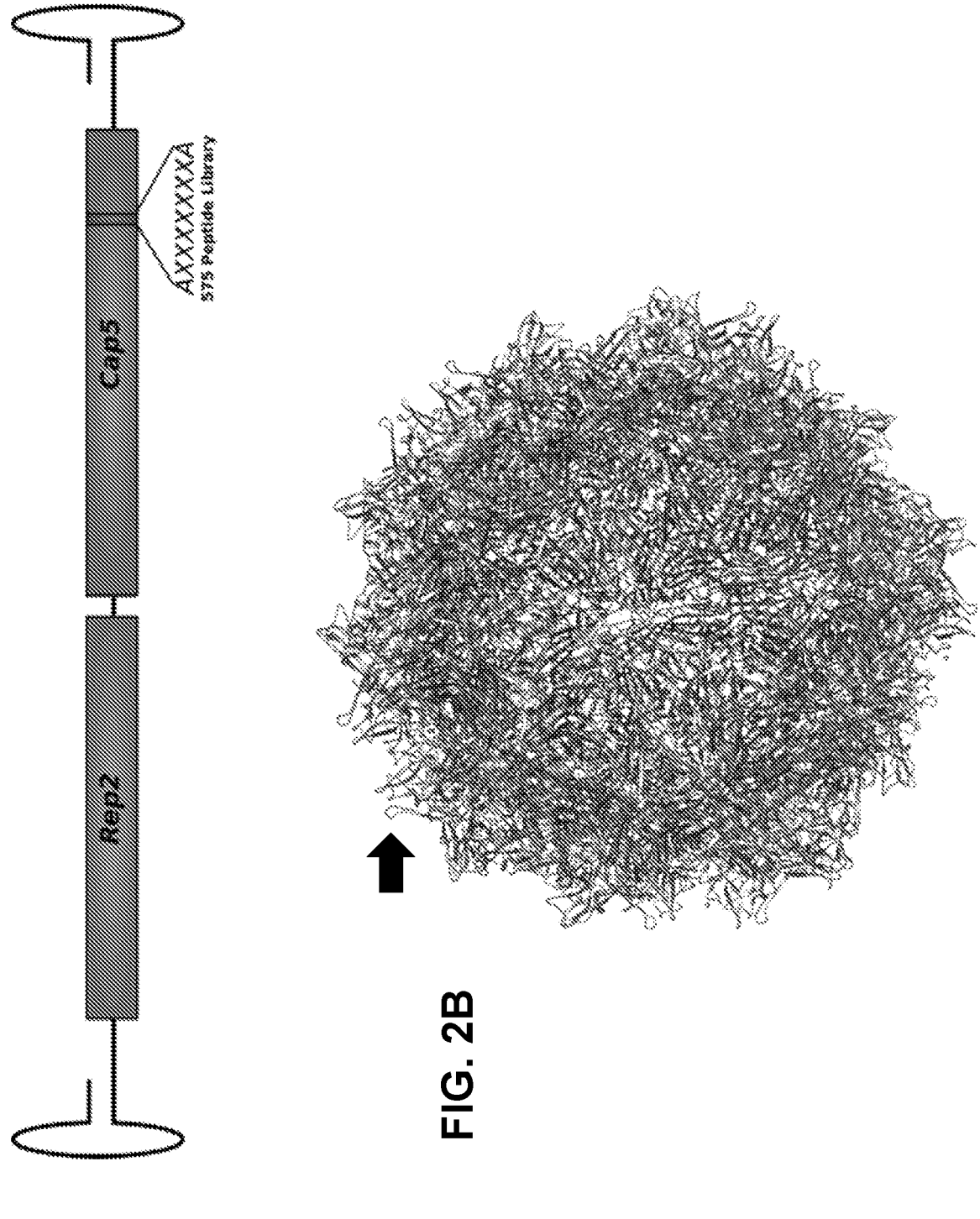
FIGS. 2A-2B depict generation of an AAV5 random peptide display library and mapping onto the crystal structure of AAV5.

A library screening strategy incorporating an initial negative selection step on induced pluripotent stem cell-derived cardiomyocytes (iPSC-CMs) followed by a positive selection step on human cardiac fibroblasts (hCFs) was performed as shown in FIG. 1. Briefly, a library of cap gene sequences was generated by PCR using primers P1 (GTCGGCGGGCAGATGGCCAC-CAACAACCAGGCCNNKNNKNNKNNKNNKNN- KNNKGCCAGCTCCAC-CACTGCCCCCGCGACCGGCACG) (SEQ ID NO: 6) and P2 (TC-CCCAGCATGAGCGATGCATTTTATT-GAGGGTATGCGAC) (SEQ ID NO: 7) {N=A, C, G, or T; K=G or T} and cloned into NotI and NheI linearized pCR-AAV-LIB575 via Gibson assembly (FIG. 2A). pCR-AAV-LIB575 was packaged into rAAV virions using the HEK293T packaging cell line. The vector contains the rep gene of AAV2 ("Rep2") and the cap gene of AAV ("Cap5") flanked by 3' and 5' inverted terminal repeats (ITRs). The random 7-mer polypeptide library flanked by alanine residues (AXXXXXXA; SEQ ID NO: 100) is inserted at position 575 in the cap gene. FIG. 2B shows the structure of the AAV5 capsid with a black arrow indicating the insertion site indicated on one of the 60 copies of the capsid protein present on the assembled AAV virion. The insertion into the cap gene results in the same polypeptide being inserted in all 60 copies at the equivalent positions (not indicated in figure).

Virions at a multiplicity of infection ranging from 50,000 (round 1) to 1,000 (round 3) were mixed in liquid culture medium and applied to iPS-CM cells isolated from a healthy 30-year old male. Cells were incubated for 24 hours at 37° C. and 5% $CO_2$. DNA was isolated from the iPS-CM cells, amplified by PCR using primers P2 (SEQ ID NO: 7) and P3 (CCATCGACGTCAGACGCGGAAGCTTCGATCAAC-TACGCAGACAG)(SEQ ID NO: 8), and sequenced using the Oxford NanoPore MiniION according to the manufacturer's instruction. Sequencing reads for this negative selection step were analyzed (data not shown)

Figure 3A:
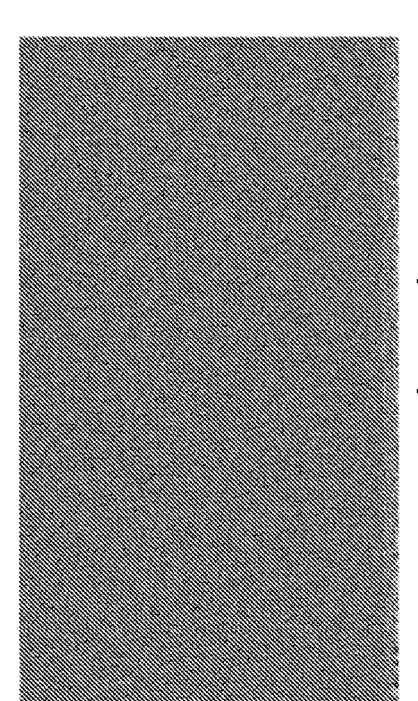
FIGS. 3A-3D visualize library complexity following each round of screening and report total number of reads and percentage of reads that are unique peptides. Each variant is represented by a different shade of gray based on the hydrophobicity of the peptide sequence, and each pixel in the image represents a single read in the library and is clustered with other reads of the same sequence. Increasing enrichment is evident based on over-abundance of reads (i.e. decrease in the percentage of reads that are unique peptides) compared to the parental library (FIG. 3A) after round 1 (FIG. 3B), after round 2 (FIG. 3C), or after round 3 (FIG. 3D).
Figure 3B:
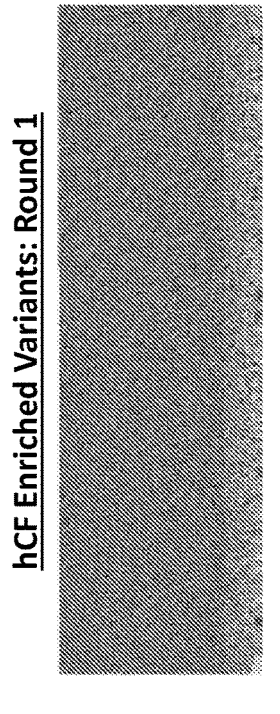

Culture media containing the rAAV virions that had not attached to or infected the iPS-CM cells was then transferred to hCF cells and incubated for 24 hours at 37° C. and 5% $CO_2$. After 24 hours, plates were washed with culture media, the adherent hCF cells were removed, and PCR amplification of cap genes and sequencing was performed on the DNA isolated from hCF cells infected with rAAV as described above. Representative data for the starting library of sequences and for the sequences after this first round of negative and positive selection are shown in FIG. 3A and FIG. 3B, respectively. Library complexity is decreased, consistent with enrichment of selected sequences, as the percentage of unique reads decreased from 97.6% to 87.5%.

Figure 3C:
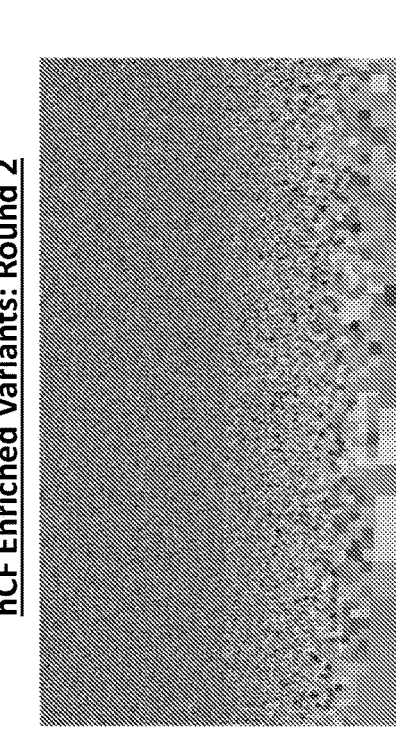
Figure 3D:
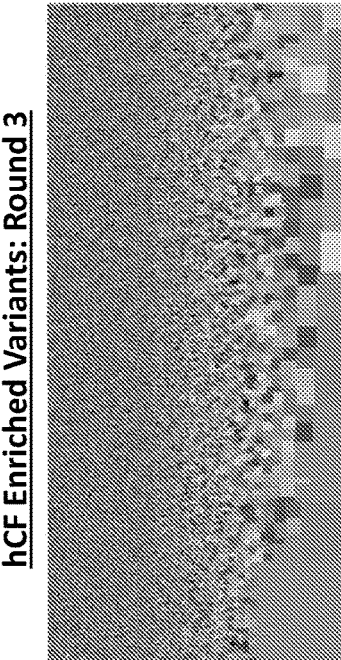

The resulting library of cap genes from the first round was subcloned into pCR-AAV-LIB575 again and the same negative and positive selection procedure was performed as round 2. This was repeated as round 3. Continued enrichment of sequences was observed by a decrease in unique reads from round 2 (FIG. 3C) to round 3 (FIG. 3D) of 58.2% to 41.5%.

Confirmation of Increased Transductions Efficiency in In Vitro System

Enrichment of reads is a experimental measurement of increased transduction efficiency, as the number of reads for each unique sequence is a correlated for increased transduction efficiency of the rAAV virion containing that insertion sequence. The 500 sequences with highest abundance are provided in Table 2 below.

The sequences listed in Table 1 were selected for re-testing in cultured hCF cells (FIGS. 4A-4D) and iPS-CM cells (FIG. 5A-5D) using a GFP reporter assay.

TABLE 1

| | | | Re-Tested Insertion Sequences | | |
|---|---|---|---|---|---|
| SEQ ID NO: | Peptide | Variant Name | Representation in hCF Library after 3 Rounds (%) | Representation in Parental Library (%) | Enrichment (Fold Increase) |
| 101 | ARKVHIEVA | CR2 | 5.4328 | 0.0022 | 2469 |
| 102 | ARKYQSDLA | CR5 | 1.6044 | 0.0045 | 357 |
| 103 | APLTNTVKA | CR17 | 1.1055 | 0.0015 | 737 |
| 104 | ALKYHGPPA | CR18 | 0.9983 | 0.0015 | 666 |
| 105 | ARKYQGDMA | CR19 | 0.8591 | 0.0007 | 1227 |
| 106 | ARKFHSTDA | CR20 | 0.8368 | 0.0004 | 2092 |
| 107 | ARKHHGLEA | CR8 | 0.7068 | 0.0007 | 1010 |
| 108 | APGTNVTKA | CR21 | 0.6159 | 0.0041 | 150 |
| 109 | ARKMHMPDA | CR22 | 0.601 | 0 | n/d |
| 110 | APLKKIVQA | CR23 | 0.3165 | 0.0015 | 211 |
| 111 | APLGKKTSA | CR24 | 0.2339 | 0.0004 | 585 |
| 112 | APRGVKVTA | CR25 | 0.2223 | 0 | n/d |
| 113 | APLAKSKSA | CR26 | 0.1448 | 0.0004 | 362 |
| 114 | APRTKGAVA | CR27 | 0.1443 | 0.0004 | 361 |
| 115 | APSGRKATA | CR28 | 0.1146 | 0.0004 | 287 | n/d = not determined

Briefly, the peptides of Table 1 were each cloned into the cap gene at the same insertion site in an Rep-Cap plasmid lacking inverted terminal repeats (ITRs), rather than in an AAV genome as in the selection experiment. These Rep-Cap plasmids were each used to express Rep2 and the respective Cap variant in order to generate rAAV packaging a reporter AAV genome (AAV2 ITRs flanking a GFP transgene controlled by a CAG promoter). The resulting rAAV virions, containing GFP transgene having the engineered capsid proteins as capsid, were plated onto adherent hCF or iPS-CM cells at on MOI of 100,000 (FIG. 4A, FIG. 5A, FIG. 5D) or 1,000 (FIG. 4D). Transduction efficiency was measured by counting GFP fluorescent cells using automated digital widefield microscopy with the Cytation 5™ cell imaging multi-mode reader. Representative fluorescent micrographs are shown in (FIG. 4B; parental AAV5 capsid—SEQ ID NO: 1) and (FIG. 4C; AAV5.CR17 capsid—SEQ ID NO: 103). Transduction efficiency of fifteen AAV5 variants in hCF cells (FIG. 4A) was benchmarked against unmodified AAV5 (right most bar). Darker bars represent sequences that resulted in increase transduction efficiency in hCF cells in this experiment.

In iPS-CM cells (FIG. 5A-5D), increased transduction frequency was also observed and in fact the fold enhancement of transduction compared to parental AAV5 was greater than in hCF cells (FIG. 5A and FIG. 5D). Representative fluorescent images are shown for hCFs transduced by either unmodified AAV5 (FIG. 5B) or AAV5.CR23 (FIG. 5C).

Figure 6A:
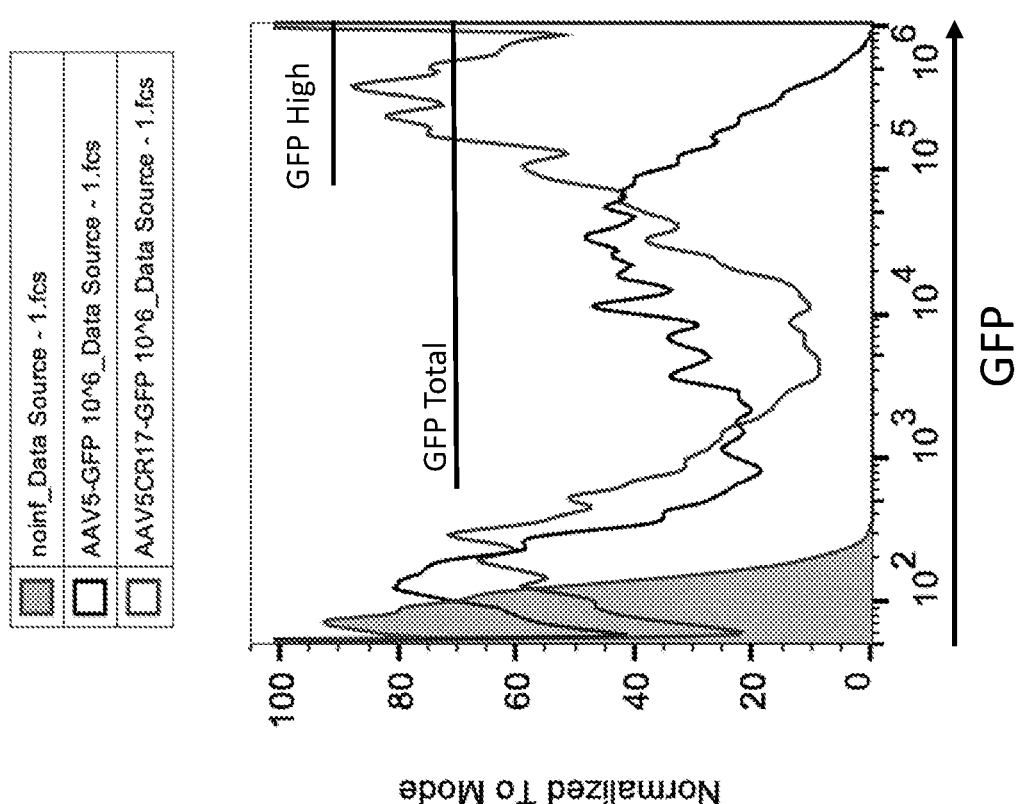
FIGS. 6A-6E demonstrate that AAV5.CR17 has improved transduction efficiency in primary mouse cardiac fibroblasts (mCFs). mCFs were infected at a high (100,000) medium (10,000) or low (1,000) MOI with either AAV5.CAG-GFP or AAV5.CR17.CAG-GFP. 72 hours following infection, transduction was assessed using flow cytometry.
Figures 6B, 6C, 6D, 6E:
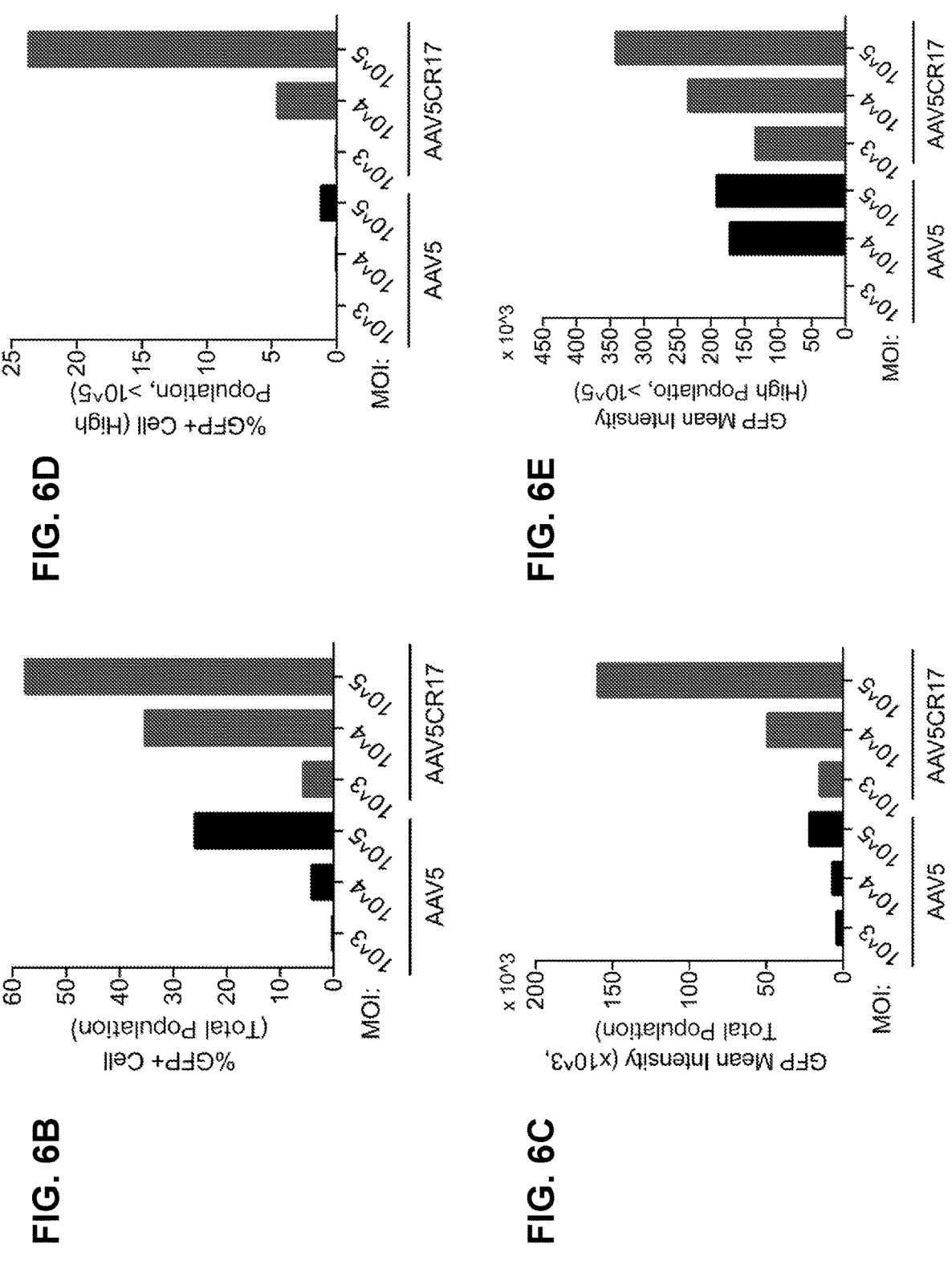
Figures 7A, 7B, 7C, 7D:
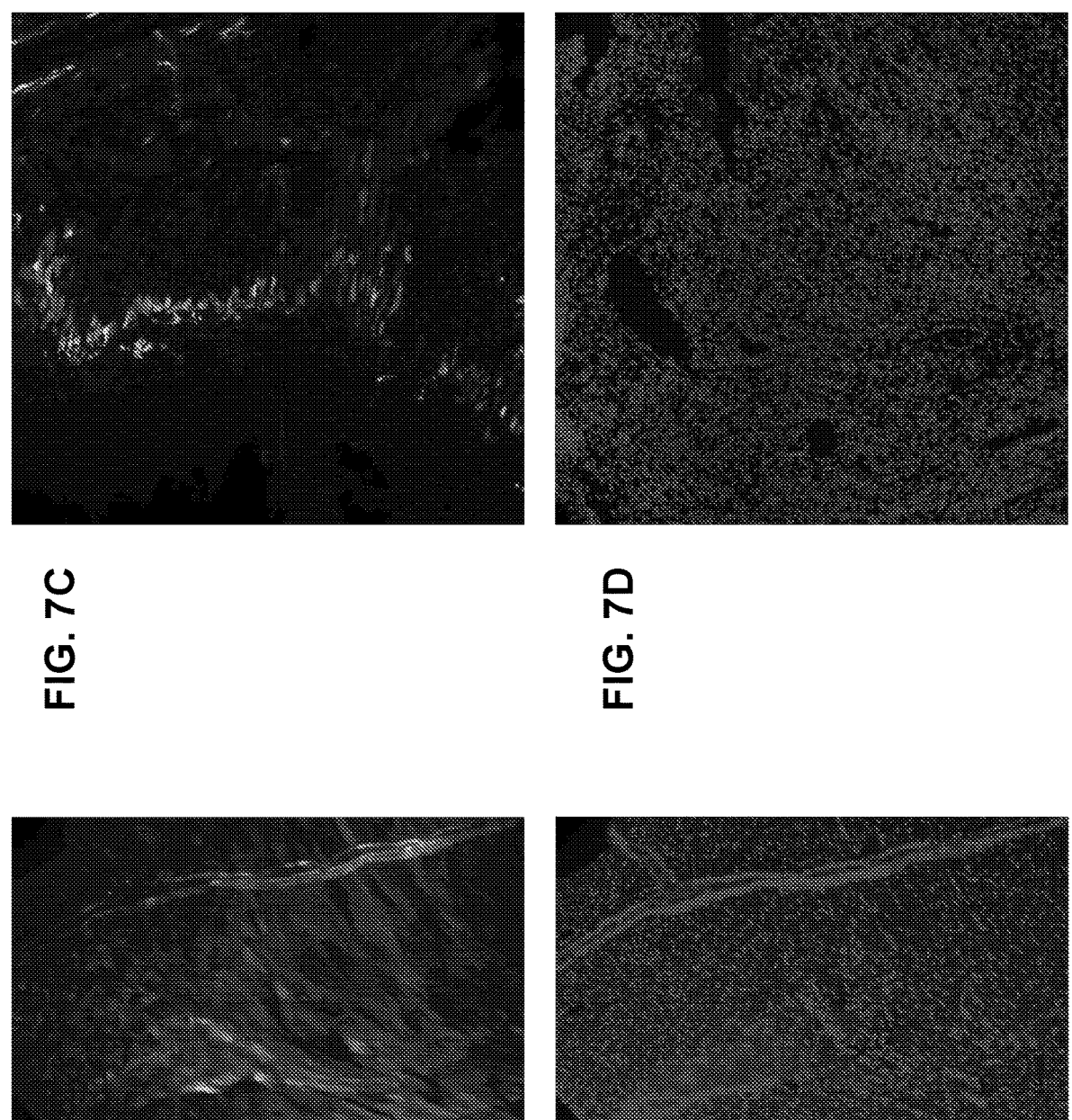
Figures 7E, 7F, 7G, 7H:
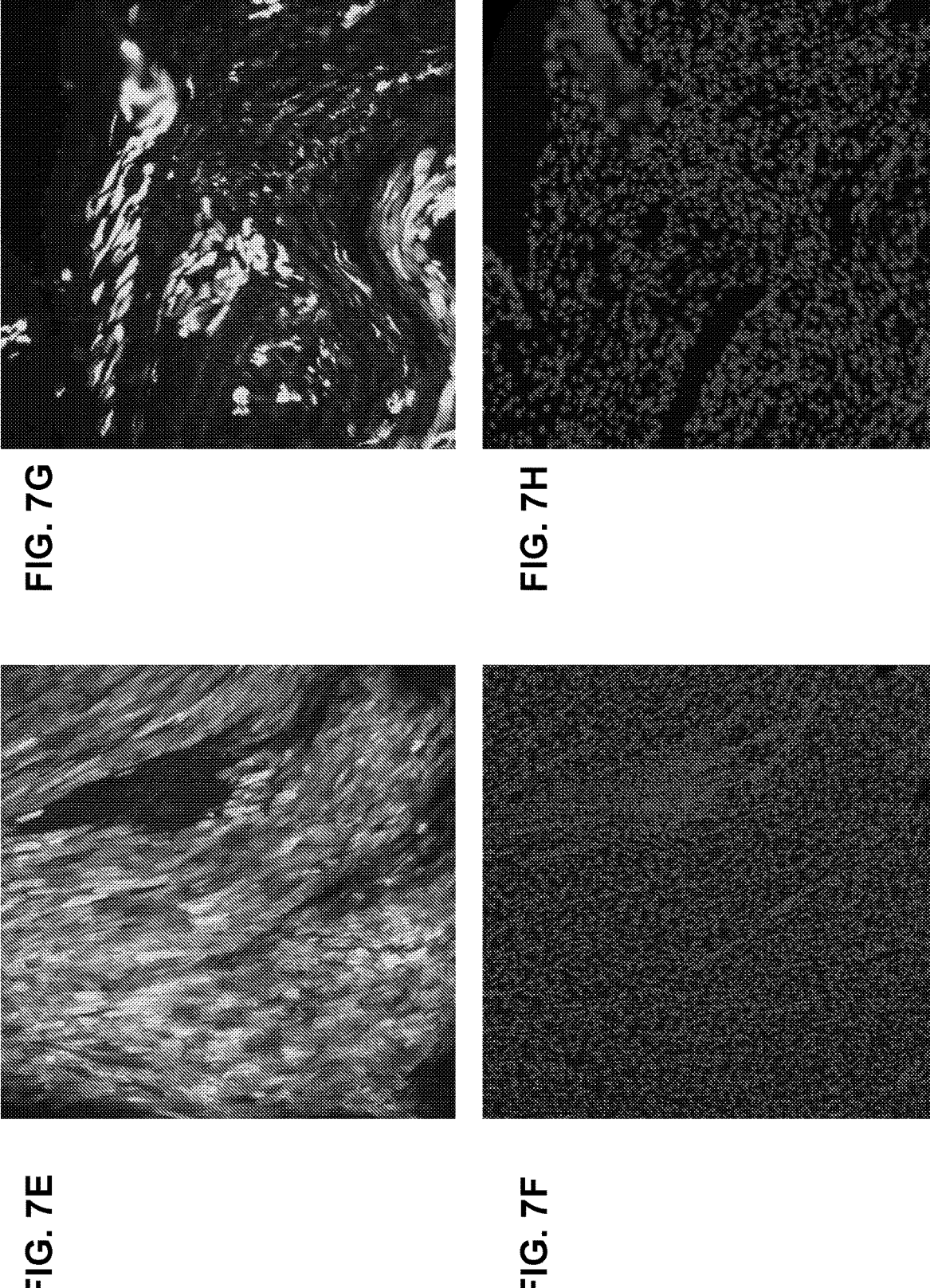

Testing with human cardiac fibroblast cells was then repeated in mouse cardiac fibroblast (mCF) cells at a high (100,000) medium (10,000) or low (1,000) MOI with either AAV5.CAG-GFP or AAV5.CR17.CAG-GFP. It was observed that in addition to increased overall numbers of GFP+ cells in AAV5.CR17 versus AAV5 test, a high-intensity GFP population is formed by AAV5.CR17, but not by AAV5 (FIG. 6A). Therefore the intensity measurements for individual cells in FIGS. 6B-6E were gated into total population and high-GFP+ population cell subsets. Increased percent GFP+(FIG. 6B) and GFP intensity (FIG. 6C) were observed in the "total GFP" population when cells were transduced with AAV5.CR17 compared to unmodified AAV5 at high, medium, or low MOI. Increased percent GFP+(FIG. 6D) and GFP intensity (FIG. 6E) were also observed in the "high GFP" population when cells were transduced with AAV5.CF17 compared to unmodified AAV5. The trend in FIG. 6E was less pronounced merely because gating on high GFP+ cells selected a population of cells with high intensity GFP expression.

In Vivo Testing

The AAV5.CR17 capsid was then tested in vivo in health and disease animals. Specifically, CD-1® IGS mice sourced from Charles River® (a wild-type background) were split into health and disease groups. The diseased group was subjected to induced myocardial infarction (MI) using the ligation method of Gao et al. *Circulation Research* (2010) 107:1445-1453. $1.2 \times 10^{11}$ vg of either AAV5.CAG-GFP or AAV5.CR17.CAG-GFP was injected into the 6-week old CD-1 mice via an intramyocardial injection. GFP intensity and distribution was assessed 7 days following an injection. All heart tissue sections were imaged using a 20× objective with equal gain and exposure. Anti-GFP immunostaining and nuclei counterstaining with DAPI are shown. Cardiomyocytes and fibroblasts were distinguished by morphology. Increased cardiomyocyte and fibroblast transduction is observed with AAV5.CR17 in both non-MI and MI animals (FIGS. 7E-7F and FIGS. 7G-7H) compared to AAV5 (FIGS. 7A-7B and FIGS. 7C-7D).

Shared Sequence Motifs

To identify residues share among insertions that demonstrate enrichment after selection, sequence motifs were generated using all sequence data, or the top sequences after round 3. Briefly, sequence motifs were generated for the top 100 (FIG. 8A), top 50 (FIG. 8B), top 20 (FIG. 8C) sequences in Table 2, as well as for the sequences that were re-tested in vitro in this Example (FIG. 8D). A sequence motif was also generated for all sequences, using the number of reads for each sequence to weight the significance of each amino acid in the motif (FIG. 8E). The sequence motifs suggest that certain amino acids are favored as certain positions in the insertion site.

The top sequences from the library are shown below in Table 2. The flanking 'A' residues at the start and end of the insertion are, in some embodiments, replaced with another amino acid, such as a flexible amino acid (G or S), or be absent.

TABLE 2

| | Ordered List of Insertion Sequences - Top 500 after hCF round 3 | | | | | | |
|---|---|---|---|---|---|---|---|
| SEQ ID NO: | Insertion | Parental | hCF round1 | hCF round2 | HCF round3 | Myocyte round 1 | Myocyte round 3 |
| 101 | ARKVHIEVA | 6 | 50 | 2681 | 11706 | 993 | 4433 |
| 102 | ARKYQSDLA | 12 | 68 | 1368 | 3457 | 540 | 1181 |
| 103 | APLTNTVKA | 4 | 43 | 1498 | 2382 | 555 | 1131 |
| 104 | ALKYHGPPA | 4 | 16 | 639 | 2151 | 286 | 818 |
| 116 | ARKIHLDAA | 0 | 4 | 376 | 2004 | 158 | 1852 |
| 105 | ARKYQGDMA | 2 | 19 | 748 | 1851 | 346 | 1895 |
| 106 | ARKFHSTDA | 1 | 5 | 417 | 1803 | 179 | 1416 |
| 107 | ARKHHGLEA | 2 | 35 | 807 | 1523 | 316 | 679 |
| 108 | APGTNVTKA | 11 | 67 | 1256 | 1327 | 475 | 614 |
| 109 | ARKMHMPDA | 0 | 18 | 331 | 1295 | 160 | 406 |
| 117 | APYHNATKA | 6 | 72 | 1115 | 1177 | 417 | 258 |
| 118 | ARKWHDTEA | 1 | 14 | 398 | 1045 | 173 | 294 |
| 119 | APVANVTKA | 4 | 28 | 930 | 995 | 374 | 310 |
| 120 | ARKVHIGVA | 1 | 6 | 196 | 931 | 76 | 741 |
| 121 | APLNNSVKA | 8 | 47 | 755 | 927 | 244 | 547 |
| 122 | ARRYHGSEA | 0 | 4 | 217 | 901 | 87 | 443 |
| 123 | AYGHPNVIA | 11 | 114 | 981 | 757 | 425 | 288 |
| 124 | APFTNSTKA | 1 | 18 | 450 | 727 | 162 | 359 |
| 110 | APLKKIVQA | 4 | 32 | 393 | 682 | 178 | 51 |
| 125 | ARKVQVGVA | 2 | 13 | 182 | 602 | 62 | 319 |
| 126 | AGRCILRVA | 0 | 1 | 118 | 591 | 63 | 286 |
| 127 | AKIKTGVPA | 8 | 57 | 642 | 554 | 282 | 124 |
| 128 | AWHNSYPHA | 0 | 18 | 331 | 531 | 133 | 278 |
| 111 | APLGKKTSA | 1 | 10 | 165 | 504 | 55 | 15 |
| 129 | APSVNLTKA | 7 | 39 | 506 | 485 | 193 | 190 |
| 112 | APRGVKVTA | 0 | 10 | 190 | 479 | 68 | 32 |
| 130 | APLSNLVKA | 3 | 18 | 323 | 475 | 134 | 184 |
| 131 | ARKFHTETA | 0 | 2 | 90 | 455 | 42 | 213 |
| 132 | AGRFILDAA | 0 | 1 | 81 | 439 | 30 | 457 |
| 133 | AVKQNQTKA | 9 | 29 | 251 | 426 | 129 | 466 |
| 134 | AVRSNKVAA | 10 | 61 | 424 | 415 | 184 | 443 |

TABLE 2-continued

Ordered List of Insertion Sequences - Top 500 after hCF round 3

| SEQ ID NO: | Insertion | Parental | hCF round1 | hCF round2 | HCF round3 | Myocyte round 1 | Myocyte round 3 |
|---|---|---|---|---|---|---|---|
| 135 | AGRCILRWA | 1 | 2 | 90 | 412 | 32 | 116 |
| 136 | ARKWQQSEA | 3 | 1 | 145 | 407 | 57 | 164 |
| 137 | APLKNGTKA | 1 | 10 | 109 | 403 | 45 | 136 |
| 138 | AGLKNAVKA | 0 | 12 | 131 | 398 | 60 | 262 |
| 139 | APAINHVKA | 2 | 20 | 414 | 349 | 171 | 112 |
| 140 | AGVLSNRIA | 9 | 54 | 450 | 348 | 170 | 173 |
| 141 | APLANTAKA | 3 | 12 | 328 | 341 | 138 | 113 |
| 142 | ARRWHGDEA | 1 | 12 | 148 | 332 | 75 | 137 |
| 143 | APLRNANKA | 3 | 28 | 267 | 329 | 106 | 87 |
| 144 | APLTNLIKA | 6 | 22 | 313 | 329 | 125 | 130 |
| 145 | ARKLQVGSA | 5 | 10 | 137 | 327 | 47 | 160 |
| 146 | AEGAYIEVA | 0 | 0 | 79 | 320 | 53 | 85 |
| 147 | APMANLVKA | 1 | 15 | 254 | 317 | 120 | 130 |
| 113 | APLAKSKSA | 1 | 16 | 198 | 312 | 77 | 17 |
| 114 | APRTKGAVA | 1 | 7 | 216 | 311 | 88 | 22 |
| 148 | AKTVNATKA | 4 | 8 | 154 | 310 | 68 | 278 |
| 149 | APVTKKASA | 0 | 5 | 153 | 301 | 56 | 19 |
| 150 | APMPNSAKA | 3 | 13 | 314 | 290 | 96 | 152 |
| 151 | AGSIQSDLA | 1 | 2 | 101 | 275 | 31 | 122 |
| 152 | ALLRNTVKA | 1 | 12 | 167 | 271 | 73 | 242 |
| 153 | AGHLSNHIA | 4 | 25 | 274 | 263 | 140 | 107 |
| 154 | APMSNRATA | 1 | 28 | 305 | 258 | 120 | 91 |
| 155 | ARKYQLDLA | 1 | 5 | 107 | 250 | 40 | 300 |
| 115 | APSGRKATA | 1 | 4 | 89 | 247 | 31 | 5 |
| 156 | APHSNSSKA | 2 | 11 | 186 | 240 | 78 | 113 |
| 157 | AGLGNAVKA | 4 | 33 | 339 | 236 | 150 | 137 |
| 158 | AGSIRGDMA | 0 | 1 | 90 | 232 | 28 | 267 |
| 159 | ALLRIRLKA | 0 | 8 | 176 | 224 | 55 | 196 |
| 160 | ARKVYIEVA | 0 | 2 | 69 | 224 | 56 | 59 |
| 161 | AWKVHIEVA | 0 | 2 | 64 | 220 | 46 | 66 |
| 162 | APRSAKPVA | 2 | 12 | 163 | 219 | 72 | 24 |
| 163 | APLANLTKA | 1 | 5 | 174 | 217 | 67 | 58 |
| 164 | APRGSAVKA | 1 | 27 | 147 | 214 | 41 | 16 |
| 165 | AGRLHIEVA | 0 | 2 | 84 | 213 | 34 | 110 |
| 166 | APLRISTKA | 0 | 2 | 123 | 202 | 72 | 82 |
| 167 | ARKWQSHEA | 2 | 2 | 92 | 198 | 37 | 67 |
| 168 | APKVHIEVA | 0 | 0 | 32 | 192 | 29 | 42 |

TABLE 2-continued

| SEQ ID NO: | Insertion | Parental | hCF round1 | hCF round2 | HCF round3 | Myocyte round 1 | Myocyte round 3 |
|---|---|---|---|---|---|---|---|
| 169 | ARRCILRWA | 0 | 1 | 55 | 189 | 23 | 40 |
| 170 | AKTKSGINA | 4 | 18 | 126 | 186 | 66 | 65 |
| 171 | APSINSVKA | 1 | 11 | 185 | 184 | 89 | 108 |
| 172 | APSLNLVKA | 6 | 30 | 246 | 175 | 89 | 53 |
| 173 | APLGNMTKA | 0 | 6 | 122 | 171 | 47 | 61 |
| 174 | ALYHNATKA | 0 | 13 | 150 | 163 | 99 | 23 |
| 175 | ALLSNLVKA | 2 | 6 | 144 | 162 | 80 | 38 |
| 176 | ALRHKSNNA | 0 | 9 | 41 | 154 | 26 | 28 |
| 177 | APRKSNASA | 1 | 21 | 147 | 151 | 68 | 24 |
| 178 | APFSNSSKA | 1 | 5 | 105 | 150 | 46 | 81 |
| 179 | AGRCILGVA | 1 | 2 | 47 | 150 | 21 | 170 |
| 180 | APASNSSRA | 2 | 22 | 147 | 149 | 61 | 72 |
| 181 | AGKYQSDLA | 0 | 2 | 62 | 146 | 43 | 57 |
| 182 | AGRCILEVA | 0 | 3 | 32 | 145 | 19 | 79 |
| 183 | ALTQNSTKA | 5 | 16 | 183 | 143 | 69 | 171 |
| 184 | ALIANATKA | 0 | 12 | 133 | 143 | 45 | 74 |
| 185 | ARKFHAMEA | 2 | 4 | 86 | 141 | 39 | 195 |
| 186 | APLRSTVKA | 1 | 11 | 53 | 139 | 19 | 5 |
| 187 | ARYSPNSVA | 0 | 15 | 166 | 137 | 77 | 64 |
| 188 | AGKVHIEVA | 0 | 1 | 38 | 137 | 14 | 49 |
| 189 | AGSISPDLA | 0 | 3 | 52 | 135 | 21 | 69 |
| 190 | ARKVHIEAA | 0 | 0 | 34 | 135 | 32 | 37 |
| 191 | ALRMNSVKA | 0 | 10 | 79 | 134 | 46 | 133 |
| 192 | APAHKVKAA | 3 | 12 | 71 | 132 | 27 | 10 |
| 193 | ACKHHGLEA | 1 | 5 | 78 | 132 | 38 | 46 |
| 194 | AGLSNATKA | 6 | 30 | 232 | 131 | 109 | 121 |
| 195 | APLANRTSA | 5 | 23 | 215 | 131 | 86 | 46 |
| 196 | AGRCILRCA | 0 | 2 | 28 | 129 | 23 | 96 |
| 197 | AQEDSFDAA | 0 | 0 | 32 | 129 | 9 | 42 |
| 198 | AVSIMGLEA | 1 | 4 | 87 | 127 | 39 | 82 |
| 199 | APGTNLIKA | 4 | 7 | 128 | 126 | 54 | 60 |
| 200 | ATSGNSVRA | 15 | 53 | 216 | 124 | 126 | 146 |
| 201 | ARFPVGSLA | 2 | 11 | 130 | 124 | 60 | 74 |
| 202 | APRVTKAAA | 0 | 9 | 122 | 124 | 54 | 5 |
| 203 | AGSFHSTDA | 0 | 1 | 29 | 124 | 6 | 83 |
| 204 | AHKALVHGA | 3 | 15 | 131 | 122 | 56 | 313 |
| 205 | ALLTNTVKA | 0 | 3 | 92 | 122 | 33 | 30 |
| 206 | ALLKKIVQA | 0 | 1 | 88 | 122 | 48 | 5 |

TABLE 2-continued

Ordered List of Insertion Sequences - Top 500 after hCF round 3

| SEQ ID NO: | Insertion | Parental | hCF round1 | hCF round2 | HCF round3 | Myocyte round 1 | Myocyte round 3 |
|---|---|---|---|---|---|---|---|
| 207 | APRDNRTSA | 4 | 20 | 167 | 121 | 58 | 57 |
| 208 | APRVNKTVA | 0 | 20 | 97 | 121 | 55 | 19 |
| 209 | AGIMSNKIA | 2 | 5 | 153 | 121 | 74 | 68 |
| 210 | ALFTNTVKA | 0 | 4 | 84 | 119 | 34 | 39 |
| 211 | APRTNITKA | 1 | 10 | 60 | 118 | 20 | 56 |
| 212 | AGSFASTDA | 0 | 1 | 26 | 118 | 18 | 128 |
| 213 | APQSNVTKA | 1 | 12 | 143 | 116 | 51 | 38 |
| 214 | AWRYHGSEA | 0 | 0 | 27 | 116 | 8 | 28 |
| 215 | APHKATKSA | 1 | 6 | 71 | 114 | 31 | 4 |
| 216 | APLTNTAKA | 1 | 2 | 72 | 114 | 23 | 33 |
| 217 | APLGNTAKA | 0 | 4 | 89 | 111 | 39 | 39 |
| 218 | APLDNRLKA | 1 | 10 | 109 | 110 | 41 | 30 |
| 219 | AGRCILSAA | 0 | 0 | 37 | 110 | 2 | 26 |
| 220 | APLINVVKA | 0 | 7 | 65 | 109 | 27 | 57 |
| 221 | AGRCILKLA | 0 | 0 | 32 | 108 | 20 | 58 |
| 222 | APISGKNKA | 0 | 3 | 41 | 105 | 16 | 5 |
| 223 | AKSKAGQVA | 6 | 13 | 113 | 102 | 31 | 35 |
| 224 | AGKIHLDAA | 0 | 0 | 15 | 102 | 20 | 90 |
| 225 | AGHTNSVKA | 1 | 8 | 100 | 101 | 54 | 92 |
| 226 | ALFTNSTKA | 1 | 1 | 59 | 98 | 24 | 38 |
| 227 | APSTNTVKA | 0 | 1 | 56 | 98 | 23 | 17 |
| 228 | ARKIHLMRA | 0 | 0 | 26 | 98 | 7 | 41 |
| 229 | APAPNSVKA | 2 | 9 | 157 | 96 | 54 | 87 |
| 230 | AGITGNKIA | 0 | 7 | 111 | 95 | 55 | 57 |
| 231 | AGRVHIEVA | 0 | 1 | 33 | 93 | 14 | 30 |
| 232 | ARKVHIEGA | 0 | 1 | 28 | 93 | 8 | 25 |
| 233 | AKKLNNSIA | 0 | 20 | 106 | 92 | 60 | 19 |
| 234 | AGSISRILA | 0 | 0 | 31 | 91 | 12 | 23 |
| 235 | AGYMGNHIA | 1 | 15 | 128 | 90 | 53 | 24 |
| 236 | AVSIMGWEA | 0 | 0 | 34 | 90 | 12 | 27 |
| 237 | AVVSNAARA | 7 | 17 | 137 | 89 | 52 | 75 |
| 238 | APRAKVVQA | 1 | 9 | 109 | 89 | 38 | 3 |
| 239 | APLGNTVRA | 2 | 11 | 76 | 88 | 31 | 35 |
| 240 | APRTTTVKA | 0 | 8 | 41 | 88 | 15 | 5 |
| 241 | APGTDVTKA | 0 | 4 | 78 | 88 | 35 | 93 |
| 242 | ALGRNVTKA | 3 | 9 | 68 | 87 | 31 | 65 |
| 243 | ALKHHGPPA | 0 | 0 | 21 | 86 | 9 | 23 |

TABLE 2-continued

| | Ordered List of Insertion Sequences - Top 500 after hCF round 3 | | | | | | |
|---|---|---|---|---|---|---|---|
| SEQ ID NO: | Insertion | Parental | hCF round1 | hCF round2 | HCF round3 | Myocyte round 1 | Myocyte round 3 |
| 244 | APLRIPTKA | 0 | 0 | 63 | 86 | 20 | 16 |
| 245 | AQATNTVRA | 8 | 39 | 148 | 85 | 59 | 72 |
| 246 | ASTGNSTRA | 4 | 34 | 124 | 85 | 60 | 103 |
| 247 | APMHNGIKA | 3 | 13 | 75 | 85 | 32 | 48 |
| 248 | ARKVHTEVA | 0 | 0 | 28 | 85 | 8 | 23 |
| 249 | AMKYHGPAA | 6 | 9 | 66 | 84 | 27 | 30 |
| 250 | ALHLNSIKA | 17 | 25 | 146 | 83 | 75 | 57 |
| 251 | APSINTIKA | 1 | 12 | 138 | 83 | 61 | 45 |
| 252 | AGRCILSVA | 0 | 0 | 12 | 83 | 4 | 12 |
| 253 | AKAKAGVAA | 0 | 11 | 72 | 82 | 28 | 26 |
| 254 | APSSNAAKA | 3 | 6 | 105 | 82 | 33 | 20 |
| 255 | ARKVQSGVA | 0 | 4 | 31 | 82 | 14 | 25 |
| 256 | AGKYQGDMA | 0 | 1 | 19 | 82 | 22 | 87 |
| 257 | AMVIPNVIA | 2 | 16 | 125 | 81 | 35 | 54 |
| 258 | AGVKHNSIA | 0 | 8 | 76 | 81 | 29 | 38 |
| 259 | ARKHQSDLA | 0 | 2 | 35 | 81 | 19 | 28 |
| 260 | AKQPNAVKA | 3 | 1 | 66 | 81 | 33 | 45 |
| 261 | AFTHPNSVA | 3 | 11 | 100 | 80 | 53 | 58 |
| 262 | APRTSTVKA | 1 | 3 | 29 | 79 | 10 | 2 |
| 263 | ARVGVKVTA | 0 | 1 | 37 | 79 | 20 | 5 |
| 264 | AEGVHIEVA | 0 | 0 | 29 | 79 | 12 | 22 |
| 265 | ASKVHIEVA | 0 | 0 | 21 | 79 | 5 | 8 |
| 266 | APLKNAISA | 7 | 39 | 188 | 78 | 65 | 22 |
| 267 | ASRNNMTKA | 1 | 12 | 44 | 78 | 29 | 61 |
| 268 | ARKVQAGVA | 0 | 0 | 22 | 78 | 8 | 19 |
| 269 | AGFTNNTKA | 4 | 18 | 132 | 76 | 61 | 23 |
| 270 | APRKVTQSA | 1 | 16 | 94 | 76 | 40 | 10 |
| 271 | APLKKGAVA | 0 | 8 | 63 | 76 | 27 | 5 |
| 272 | APGKSTAKA | 2 | 3 | 43 | 76 | 18 | 3 |
| 273 | AGRCILGCA | 0 | 2 | 10 | 76 | 14 | 54 |
| 274 | ALNINSTKA | 2 | 9 | 109 | 75 | 50 | 65 |
| 275 | APLGNGAKA | 1 | 7 | 90 | 75 | 39 | 18 |
| 276 | AGNHPNKVA | 1 | 4 | 95 | 75 | 54 | 55 |
| 277 | AKNVHPNSA | 1 | 13 | 107 | 74 | 55 | 57 |
| 278 | APLKAKTSA | 0 | 7 | 73 | 74 | 20 | 4 |
| 279 | APLQNSVKA | 1 | 2 | 57 | 74 | 20 | 28 |
| 280 | AKYKQGVSA | 1 | 2 | 68 | 74 | 22 | 17 |
| 281 | AGSGMILEA | 0 | 1 | 36 | 74 | 20 | 11 |

TABLE 2-continued

| | | | | | | | |
|---|---|---|---|---|---|---|---|
| Ordered List of Insertion Sequences - Top 500 after hCF round 3 | | | | | | | |
| SEQ ID NO: | Insertion | Parental | hCF round1 | hCF round2 | HCF round3 | Myocyte round 1 | Myocyte round 3 |
| 282 | ARKVHVPVA | 2 | 16 | 54 | 73 | 18 | 42 |
| 283 | ARKIQTMSA | 3 | 15 | 37 | 73 | 19 | 30 |
| 284 | ALRGNKIQA | 0 | 8 | 58 | 73 | 27 | 50 |
| 285 | APIANNTRA | 2 | 8 | 75 | 73 | 32 | 26 |
| 286 | AFHHPNAVA | 0 | 6 | 76 | 73 | 34 | 33 |
| 287 | ALKVHIEVA | 0 | 1 | 15 | 73 | 9 | 22 |
| 288 | APRGVKTTA | 0 | 5 | 23 | 72 | 12 | 2 |
| 289 | AGSFMSTDA | 0 | 0 | 11 | 72 | 6 | 108 |
| 290 | AKQIHPNSA | 3 | 27 | 148 | 71 | 68 | 47 |
| 291 | ARWRNVTKA | 0 | 2 | 89 | 71 | 15 | 53 |
| 292 | ARKYRGDMA | 0 | 1 | 33 | 71 | 25 | 110 |
| 293 | APLHNRNNA | 1 | 13 | 103 | 70 | 41 | 19 |
| 294 | APHSNRTVA | 5 | 18 | 120 | 69 | 55 | 30 |
| 295 | AGIRNVVKA | 1 | 14 | 43 | 69 | 26 | 62 |
| 296 | ARSSKPNSA | 3 | 13 | 59 | 69 | 32 | 21 |
| 297 | ARTKNGVPA | 3 | 12 | 67 | 69 | 33 | 22 |
| 298 | ARYHANSIA | 0 | 9 | 65 | 69 | 23 | 30 |
| 299 | AVRTNAVKA | 0 | 6 | 37 | 69 | 14 | 127 |
| 300 | AIVSNHSKA | 8 | 18 | 104 | 68 | 45 | 51 |
| 301 | APFDNHIRA | 0 | 13 | 92 | 68 | 42 | 19 |
| 302 | APRKPNASA | 0 | 7 | 65 | 68 | 15 | 6 |
| 303 | ARKVHIGGA | 0 | 0 | 14 | 68 | 11 | 34 |
| 304 | AKRASGPTA | 2 | 12 | 88 | 67 | 44 | 10 |
| 305 | AECESYFKA | 1 | 2 | 84 | 67 | 26 | 23 |
| 306 | APPGRKSSA | 1 | 1 | 24 | 67 | 4 | 2 |
| 307 | ARKYQGDIA | 0 | 0 | 35 | 67 | 23 | 107 |
| 308 | APITNRSTA | 5 | 21 | 109 | 66 | 54 | 21 |
| 309 | APRSVGKAA | 0 | 12 | 68 | 66 | 29 | 12 |
| 310 | ACKMHMPDA | 0 | 2 | 13 | 66 | 18 | 18 |
| 311 | APLNKKVAA | 0 | 1 | 25 | 66 | 13 | 2 |
| 312 | APIANKVSA | 3 | 18 | 88 | 65 | 25 | 31 |
| 313 | APRSGVTKA | 0 | 10 | 41 | 65 | 11 | 5 |
| 314 | AIRHPNVVA | 0 | 9 | 115 | 65 | 67 | 42 |
| 315 | APYQNIVKA | 2 | 7 | 73 | 65 | 24 | 14 |
| 316 | AFTANSTKA | 0 | 2 | 53 | 65 | 22 | 44 |
| 317 | ARKHQGDMA | 0 | 1 | 34 | 65 | 9 | 39 |
| 318 | APLRILLKA | 0 | 1 | 42 | 65 | 17 | 32 |

TABLE 2-continued

| Ordered List of Insertion Sequences - Top 500 after hCF round 3 | | | | | | | |
|---|---|---|---|---|---|---|---|
| SEQ ID NO: | Insertion | Parental | hCF round1 | hCF round2 | HCF round3 | Myocyte round 1 | Myocyte round 3 |
| 319 | AEGAHIEVA | 0 | 0 | 20 | 65 | 20 | 30 |
| 320 | AGYSNSVKA | 9 | 23 | 138 | 64 | 60 | 80 |
| 321 | APLTNRISA | 1 | 12 | 83 | 64 | 35 | 19 |
| 322 | APPHAKKNA | 0 | 1 | 24 | 64 | 6 | 3 |
| 323 | AGSFLSTDA | 0 | 0 | 15 | 64 | 2 | 97 |
| 324 | ARKYQFDLA | 0 | 0 | 38 | 64 | 10 | 22 |
| 325 | ARLRNTAKA | 0 | 4 | 65 | 63 | 23 | 43 |
| 326 | ARKMHMLDA | 0 | 0 | 20 | 63 | 8 | 6 |
| 327 | APVLNSAKA | 2 | 14 | 100 | 62 | 45 | 14 |
| 328 | AGISRNSVA | 0 | 9 | 61 | 62 | 21 | 21 |
| 329 | ARSNNTIKA | 1 | 7 | 73 | 61 | 24 | 32 |
| 330 | AGVLRNSIA | 2 | 6 | 73 | 61 | 45 | 28 |
| 331 | ALLRNSTKA | 0 | 5 | 58 | 61 | 20 | 69 |
| 332 | AQIHPNSVA | 1 | 5 | 79 | 61 | 43 | 24 |
| 333 | AYIHNSTKA | 3 | 13 | 85 | 60 | 46 | 55 |
| 334 | ALLRILLKA | 0 | 2 | 43 | 60 | 12 | 41 |
| 335 | APRKNNNSA | 1 | 18 | 83 | 59 | 21 | 12 |
| 336 | AGIVANAIA | 6 | 17 | 123 | 59 | 60 | 13 |
| 337 | APRKNTVNA | 1 | 7 | 66 | 59 | 25 | 9 |
| 338 | ALLRISTKA | 0 | 2 | 44 | 59 | 22 | 18 |
| 339 | APGSRKAAA | 0 | 2 | 32 | 59 | 9 | 1 |
| 340 | APKAKGGGA | 0 | 23 | 74 | 58 | 31 | 6 |
| 341 | APARQKSGA | 3 | 12 | 62 | 58 | 21 | 9 |
| 342 | AKSKLGVVA | 5 | 8 | 84 | 58 | 22 | 15 |
| 343 | APRGTGKAA | 1 | 8 | 27 | 58 | 12 | 3 |
| 344 | APVADVTKA | 1 | 5 | 83 | 58 | 47 | 60 |
| 345 | AKITNASKA | 0 | 5 | 43 | 58 | 12 | 52 |
| 346 | APRKQTTSA | 0 | 4 | 26 | 58 | 9 | 4 |
| 347 | ALLRNANKA | 0 | 3 | 49 | 58 | 36 | 10 |
| 348 | ARKYPVSLA | 0 | 1 | 20 | 58 | 8 | 34 |
| 349 | APRGNEVKA | 0 | 4 | 32 | 57 | 13 | 8 |
| 350 | AWDECVTKA | 0 | 2 | 48 | 57 | 37 | 12 |
| 351 | ARKWQQFEA | 0 | 1 | 13 | 57 | 9 | 8 |
| 352 | ASLTNTVKA | 0 | 0 | 39 | 57 | 14 | 29 |
| 353 | AGLANAVRA | 5 | 27 | 118 | 56 | 31 | 44 |
| 354 | ARSGNKVNA | 3 | 11 | 71 | 56 | 30 | 30 |
| 355 | APRNNSSKA | 1 | 2 | 28 | 56 | 6 | 17 |
| 356 | AFSHPNMIA | 2 | 10 | 64 | 55 | 23 | 28 |

75 76

TABLE 2-continued

Ordered List of Insertion Sequences - Top 500 after hCF round 3

| SEQ ID NO: | Insertion | Parental | hCF round1 | hCF round2 | HCF round3 | Myocyte round 1 | Myocyte round 3 |
|---|---|---|---|---|---|---|---|
| 357 | APMTNKVSA | 1 | 5 | 79 | 55 | 36 | 18 |
| 358 | AGSFQVGSA | 0 | 3 | 28 | 54 | 8 | 37 |
| 359 | ALYEFYFKA | 0 | 1 | 46 | 54 | 15 | 14 |
| 360 | APRASGSKA | 2 | 1 | 32 | 54 | 16 | 5 |
| 361 | AGRFIWMRA | 0 | 0 | 11 | 54 | 8 | 49 |
| 362 | ALGSNSVRA | 7 | 45 | 82 | 53 | 44 | 59 |
| 363 | AGSFIVLDA | 0 | 1 | 12 | 53 | 8 | 21 |
| 364 | APGHKAAKA | 0 | 0 | 20 | 53 | 7 | 6 |
| 365 | APIKAVKTA | 2 | 12 | 46 | 52 | 15 | 7 |
| 366 | APMSNRAAA | 0 | 8 | 58 | 52 | 21 | 33 |
| 367 | APLMNKVVA | 0 | 8 | 86 | 52 | 59 | 16 |
| 368 | ARYMGNSIA | 2 | 7 | 78 | 52 | 33 | 11 |
| 369 | APRVAKPLA | 1 | 7 | 42 | 52 | 17 | 5 |
| 370 | ARLGNASKA | 1 | 6 | 33 | 52 | 17 | 34 |
| 371 | ARKVRVGVA | 0 | 0 | 18 | 52 | 7 | 35 |
| 372 | ASMNNSTKA | 5 | 16 | 100 | 51 | 49 | 33 |
| 373 | ALVRNDTRA | 5 | 13 | 59 | 51 | 21 | 50 |
| 374 | APAMNITKA | 2 | 7 | 65 | 51 | 26 | 24 |
| 375 | APLNKKLSA | 1 | 4 | 38 | 51 | 11 | 3 |
| 376 | APYRQCYEA | 1 | 3 | 41 | 51 | 12 | 16 |
| 377 | APKLATTKA | 0 | 3 | 25 | 51 | 12 | 4 |
| 378 | APAWVKVTA | 0 | 2 | 12 | 51 | 9 | 1 |
| 379 | APLTNAVKA | 0 | 0 | 12 | 51 | 15 | 44 |
| 380 | AGRLHIGVA | 0 | 0 | 19 | 51 | 9 | 41 |
| 381 | AGVIMGREA | 0 | 0 | 13 | 51 | 5 | 22 |
| 382 | APLPNSIKA | 1 | 0 | 49 | 51 | 26 | 18 |
| 383 | APSGKKTSA | 0 | 0 | 11 | 51 | 10 | 0 |
| 384 | APRVSGAKA | 1 | 5 | 32 | 50 | 6 | 1 |
| 385 | ARVDNKVKA | 0 | 4 | 21 | 50 | 11 | 27 |
| 386 | ARKVHIRVA | 0 | 1 | 17 | 50 | 8 | 33 |
| 387 | AGSIQGDMA | 1 | 0 | 22 | 50 | 13 | 88 |
| 388 | AGKFHSTDA | 0 | 0 | 14 | 50 | 14 | 46 |
| 389 | AGSISRICA | 0 | 0 | 15 | 50 | 8 | 13 |
| 390 | AGISSNKTA | 4 | 14 | 69 | 49 | 24 | 14 |
| 391 | APHVNTVRA | 1 | 13 | 64 | 49 | 24 | 27 |
| 392 | ALRNKAAQA | 0 | 5 | 38 | 49 | 18 | 10 |
| 393 | APRLNEVKA | 2 | 4 | 64 | 49 | 22 | 17 |

TABLE 2-continued

Ordered List of Insertion Sequences - Top 500 after hCF round 3

| SEQ ID NO: | Insertion | Parental | hCF round1 | hCF round2 | HCF round3 | Myocyte round 1 | Myocyte round 3 |
|---|---|---|---|---|---|---|---|
| 394 | AGVHMNSIA | 0 | 4 | 54 | 49 | 36 | 16 |
| 395 | APFTDSTKA | 0 | 1 | 20 | 49 | 4 | 59 |
| 396 | AARYHGSEA | 0 | 1 | 10 | 49 | 3 | 14 |
| 397 | APAGNEVKA | 2 | 1 | 62 | 49 | 29 | 12 |
| 398 | AKVHIIEVA | 0 | 0 | 14 | 49 | 15 | 24 |
| 399 | AGRCMAEVA | 0 | 0 | 9 | 49 | 3 | 9 |
| 400 | APLAKSSKA | 0 | 0 | 22 | 49 | 5 | 1 |
| 401 | APVSNTTRA | 2 | 13 | 64 | 48 | 27 | 18 |
| 402 | AGVVTNHVA | 0 | 11 | 84 | 48 | 37 | 9 |
| 403 | AWDEDVTKA | 2 | 6 | 38 | 48 | 25 | 28 |
| 404 | ALTANTVKA | 1 | 3 | 38 | 48 | 21 | 45 |
| 405 | ALLRDTVKA | 0 | 3 | 25 | 48 | 13 | 44 |
| 406 | AQRYHGSEA | 0 | 2 | 11 | 48 | 4 | 58 |
| 407 | ARVRRGAVA | 0 | 2 | 37 | 48 | 17 | 6 |
| 408 | APLVKTTKA | 0 | 1 | 18 | 48 | 9 | 2 |
| 409 | AAKYHGPPA | 0 | 0 | 13 | 48 | 5 | 27 |
| 410 | AGIRNNSTA | 3 | 19 | 100 | 47 | 41 | 37 |
| 411 | AKTGGKVAA | 2 | 19 | 78 | 47 | 29 | 10 |
| 412 | ARFPAGSLA | 5 | 12 | 99 | 47 | 44 | 9 |
| 413 | APGGKANKA | 0 | 5 | 24 | 47 | 16 | 1 |
| 414 | AYTKKSVAA | 3 | 3 | 45 | 47 | 28 | 7 |
| 415 | APGTNVIKA | 0 | 1 | 54 | 47 | 31 | 13 |
| 416 | AGSGMILRA | 0 | 1 | 24 | 47 | 6 | 12 |
| 417 | APKGTTAKA | 0 | 1 | 31 | 47 | 16 | 1 |
| 418 | ARKIHFGCA | 0 | 0 | 6 | 47 | 4 | 68 |
| 419 | ALTTNSIRA | 6 | 16 | 88 | 46 | 41 | 38 |
| 420 | ARWQIFTKA | 0 | 8 | 49 | 46 | 21 | 34 |
| 421 | AGSVNSVKA | 3 | 6 | 54 | 46 | 34 | 28 |
| 422 | APSATKNKA | 0 | 1 | 21 | 46 | 3 | 1 |
| 423 | ARKVHIECA | 0 | 0 | 13 | 46 | 7 | 21 |
| 424 | AAAGNQVKA | 26 | 45 | 154 | 45 | 64 | 38 |
| 425 | AMVSNATKA | 3 | 14 | 122 | 45 | 56 | 46 |
| 426 | AGIVTNHVA | 1 | 10 | 80 | 45 | 42 | 16 |
| 427 | ALSLNATKA | 0 | 7 | 58 | 45 | 17 | 25 |
| 428 | APLANTVKA | 0 | 3 | 25 | 45 | 19 | 48 |
| 429 | APYRNATKA | 0 | 3 | 45 | 45 | 19 | 30 |
| 430 | AGRCILKVA | 0 | 0 | 16 | 45 | 7 | 18 |
| 431 | AWSRSPNAA | 2 | 18 | 90 | 44 | 45 | 39 |

TABLE 2-continued

Ordered List of Insertion Sequences - Top 500 after hCF round 3

| SEQ ID NO: | Insertion | Parental | hCF round1 | hCF round2 | HCF round3 | Myocyte round 1 | Myocyte round 3 |
|---|---|---|---|---|---|---|---|
| 432 | AMASNSVRA | 3 | 15 | 56 | 44 | 29 | 54 |
| 433 | AMAQNSVKA | 7 | 14 | 122 | 44 | 51 | 64 |
| 434 | AGIQNNHIA | 0 | 14 | 95 | 44 | 43 | 18 |
| 435 | APLKLKAAA | 1 | 4 | 43 | 44 | 19 | 7 |
| 436 | APYHIATKA | 0 | 3 | 39 | 44 | 20 | 6 |
| 437 | ARWRMLLKA | 0 | 0 | 41 | 44 | 22 | 17 |
| 438 | APKKSGSPA | 0 | 12 | 69 | 43 | 33 | 5 |
| 439 | ARMSNKTSA | 0 | 8 | 38 | 43 | 12 | 35 |
| 440 | AGRLTNQIA | 2 | 8 | 59 | 43 | 25 | 11 |
| 441 | APRAGKAAA | 1 | 7 | 59 | 43 | 16 | 6 |
| 442 | AGTKNMIKA | 3 | 5 | 49 | 43 | 29 | 21 |
| 443 | ARKIHLDTA | 0 | 0 | 10 | 43 | 5 | 47 |
| 444 | ARMSNESRA | 10 | 19 | 84 | 42 | 41 | 31 |
| 445 | AVVSNAAQA | 3 | 10 | 47 | 42 | 10 | 56 |
| 446 | APRTVGNKA | 0 | 7 | 28 | 42 | 13 | 4 |
| 447 | APSVDLTKA | 1 | 6 | 48 | 42 | 11 | 39 |
| 448 | APRKNSAAA | 0 | 6 | 51 | 42 | 16 | 16 |
| 449 | APIGNTTRA | 0 | 5 | 36 | 42 | 13 | 13 |
| 450 | AKYIPGTLA | 1 | 5 | 48 | 42 | 17 | 6 |
| 451 | APRKPGVQA | 0 | 5 | 44 | 42 | 9 | 3 |
| 452 | APRKTSATA | 0 | 3 | 29 | 42 | 10 | 3 |
| 453 | APFADSTKA | 0 | 2 | 21 | 42 | 14 | 37 |
| 454 | APHTKSKSA | 0 | 2 | 11 | 42 | 10 | 1 |
| 455 | ARKFRSTDA | 0 | 1 | 12 | 42 | 5 | 68 |
| 456 | AGSIRSDLA | 0 | 1 | 14 | 42 | 7 | 7 |
| 457 | ASYEDTVKA | 1 | 0 | 34 | 42 | 6 | 32 |
| 458 | ALLRIRLRA | 0 | 0 | 29 | 42 | 13 | 15 |
| 459 | ARRCILRVA | 0 | 0 | 11 | 42 | 5 | 11 |
| 460 | AGTLNAIKA | 7 | 13 | 78 | 41 | 39 | 24 |
| 461 | AQRHNDTRA | 9 | 12 | 101 | 41 | 37 | 40 |
| 462 | ARKLQSAQA | 5 | 10 | 44 | 41 | 14 | 20 |
| 463 | AKVKGTSAA | 3 | 10 | 53 | 41 | 23 | 10 |
| 464 | APRSVQKSA | 1 | 9 | 56 | 41 | 31 | 4 |
| 465 | APRGNNLKA | 0 | 3 | 28 | 41 | 8 | 5 |
| 466 | APYHNVTKA | 1 | 2 | 50 | 41 | 25 | 8 |
| 467 | AGRCMARVA | 0 | 1 | 7 | 41 | 6 | 38 |
| 468 | ARKWYDTEA | 0 | 0 | 17 | 41 | 9 | 13 |

TABLE 2-continued

| | Ordered List of Insertion Sequences - Top 500 after hCF round 3 | | | | | | |
|---|---|---|---|---|---|---|---|
| SEQ ID NO: | Insertion | Parental | hCF round1 | hCF round2 | HCF round3 | Myocyte round 1 | Myocyte round 3 |
| 469 | ARKFHSIDA | 0 | 0 | 12 | 41 | 5 | 8 |
| 470 | AKKIDNRVA | 1 | 7 | 69 | 40 | 28 | 28 |
| 471 | AGAHPNSLA | 0 | 3 | 43 | 40 | 28 | 10 |
| 472 | APMGRKAAA | 0 | 3 | 17 | 40 | 14 | 7 |
| 473 | AGKWHDTEA | 0 | 0 | 21 | 40 | 8 | 19 |
| 474 | APFYEFTKA | 0 | 0 | 31 | 40 | 12 | 14 |
| 475 | APNRKSATA | 1 | 13 | 72 | 39 | 24 | 4 |
| 476 | APSGNSSRA | 2 | 10 | 39 | 39 | 13 | 10 |
| 477 | AAQGNTVRA | 2 | 9 | 54 | 39 | 21 | 30 |
| 478 | APRTKSIVA | 0 | 9 | 59 | 39 | 34 | 6 |
| 479 | APHLNLAKA | 1 | 8 | 55 | 39 | 16 | 17 |
| 480 | APRGAKSSA | 0 | 5 | 25 | 39 | 12 | 1 |
| 481 | APKITKPSA | 0 | 3 | 34 | 39 | 13 | 6 |
| 482 | ARKYRSDLA | 0 | 2 | 16 | 39 | 14 | 14 |
| 483 | ARKYQSSLA | 0 | 0 | 18 | 39 | 10 | 29 |
| 484 | ARKWRQSEA | 0 | 0 | 15 | 39 | 5 | 25 |
| 485 | AVKMHMPDA | 0 | 0 | 18 | 39 | 4 | 22 |
| 486 | AKVGGKAAA | 0 | 10 | 39 | 38 | 10 | 2 |
| 487 | APRQVSKTA | 1 | 7 | 36 | 38 | 11 | 9 |
| 488 | APATTKVKA | 0 | 5 | 18 | 38 | 7 | 1 |
| 489 | ARKIHDGPA | 0 | 3 | 21 | 38 | 5 | 13 |
| 490 | AGILRNTIA | 3 | 3 | 46 | 38 | 18 | 8 |
| 491 | APSSGKKVA | 0 | 3 | 33 | 38 | 13 | 1 |
| 492 | APRSAKPAA | 0 | 3 | 29 | 38 | 18 | 0 |
| 493 | ARWRIFTKA | 1 | 2 | 42 | 38 | 24 | 20 |
| 494 | AKVNNLTKA | 2 | 2 | 20 | 38 | 17 | 19 |
| 495 | APNSNIIKA | 0 | 2 | 35 | 38 | 8 | 13 |
| 496 | ARKWHDAEA | 0 | 1 | 18 | 38 | 8 | 24 |
| 497 | AGSFHTETA | 0 | 1 | 11 | 38 | 3 | 11 |
| 498 | ARKYPVGFA | 0 | 0 | 19 | 38 | 3 | 25 |
| 499 | ALRGVKVTA | 0 | 0 | 23 | 38 | 6 | 1 |
| 500 | APLGKKISA | 0 | 0 | 9 | 38 | 8 | 0 |
| 501 | ARATNEVRA | 2 | 17 | 74 | 37 | 35 | 38 |
| 502 | APGGNEVRA | 1 | 13 | 71 | 37 | 30 | 12 |
| 503 | ALLGNAVKA | 2 | 8 | 64 | 37 | 25 | 38 |
| 504 | APHSNRVSA | 1 | 8 | 49 | 37 | 18 | 16 |
| 505 | APRSKNAVA | 0 | 6 | 62 | 37 | 20 | 5 |
| 506 | APSINKVKA | 0 | 5 | 4 | 37 | 3 | 3 |

TABLE 2-continued

Ordered List of Insertion Sequences - Top 500 after hCF round 3

| SEQ ID NO: | Insertion | Parental | hCF round1 | hCF round2 | HCF round3 | Myocyte round 1 | Myocyte round 3 |
|---|---|---|---|---|---|---|---|
| 507 | APAANTVRA | 2 | 4 | 51 | 37 | 22 | 20 |
| 508 | ALCRNSAKA | 0 | 3 | 34 | 37 | 9 | 28 |
| 509 | APLRSAVKA | 1 | 3 | 32 | 37 | 9 | 3 |
| 510 | APLKKHAAA | 0 | 3 | 18 | 37 | 5 | 2 |
| 511 | APLTNTVGA | 0 | 1 | 34 | 37 | 12 | 33 |
| 512 | ALLIILVKA | 0 | 1 | 26 | 37 | 9 | 8 |
| 513 | ALMSNRATA | 0 | 1 | 38 | 37 | 20 | 7 |
| 514 | APLVNAVKA | 0 | 0 | 26 | 37 | 12 | 23 |
| 515 | APSSKKATA | 0 | 0 | 12 | 37 | 2 | 0 |
| 516 | AKFIIGSLA | 4 | 12 | 83 | 36 | 35 | 6 |
| 517 | APSTNRVTA | 1 | 7 | 54 | 36 | 17 | 8 |
| 518 | APKAPNKSA | 0 | 4 | 45 | 36 | 9 | 5 |
| 519 | AKVKLGAAA | 3 | 3 | 26 | 36 | 9 | 12 |
| 520 | AEVSVPDLA | 0 | 1 | 12 | 36 | 7 | 15 |
| 521 | AGSFIGTDA | 0 | 0 | 10 | 36 | 0 | 35 |
| 522 | AEVSYSTDA | 0 | 0 | 8 | 36 | 4 | 19 |
| 523 | AGRCIAEVA | 0 | 0 | 14 | 36 | 7 | 7 |
| 524 | ARKYQSDFA | 0 | 0 | 21 | 36 | 6 | 7 |
| 525 | AALGNVVRA | 9 | 19 | 75 | 35 | 37 | 40 |
| 526 | AVASNVVKA | 2 | 14 | 70 | 35 | 29 | 31 |
| 527 | ALAGNAVKA | 5 | 14 | 59 | 35 | 29 | 23 |
| 528 | APASNVARA | 2 | 12 | 49 | 35 | 22 | 14 |
| 529 | AYGHPIVIA | 3 | 3 | 61 | 35 | 21 | 11 |
| 530 | ALWLNLVKA | 0 | 2 | 38 | 35 | 9 | 25 |
| 531 | ALSVNLTKA | 2 | 2 | 78 | 35 | 54 | 19 |
| 532 | APLRNSTKA | 0 | 2 | 11 | 35 | 5 | 18 |
| 533 | ALYHPNKVA | 0 | 2 | 33 | 35 | 19 | 17 |
| 534 | ARRYQSDLA | 0 | 1 | 10 | 35 | 3 | 21 |
| 535 | AAKAMKLGA | 0 | 13 | 46 | 34 | 20 | 12 |
| 536 | AAMGNASRA | 2 | 8 | 51 | 34 | 34 | 44 |
| 537 | APRALKITA | 0 | 5 | 47 | 34 | 18 | 5 |
| 538 | ALSLNLVKA | 3 | 5 | 52 | 34 | 31 | 2 |
| 539 | ALVANVTKA | 0 | 4 | 50 | 34 | 30 | 11 |
| 540 | AKFVPGTLA | 2 | 3 | 65 | 34 | 33 | 14 |
| 541 | ASIHPNAIA | 1 | 3 | 42 | 34 | 23 | 9 |
| 542 | AKMKVGVSA | 0 | 3 | 26 | 34 | 10 | 4 |
| 543 | APVGAKKGA | 0 | 2 | 19 | 34 | 6 | 0 |

TABLE 2-continued

| SEQ ID NO: | Insertion | Parental | hCF round1 | hCF round2 | HCF round3 | Myocyte round 1 | Myocyte round 3 |
|---|---|---|---|---|---|---|---|
| 544 | ASYEYTVKA | 0 | 1 | 17 | 34 | 12 | 14 |
| 545 | AQEVSVDLA | 0 | 1 | 17 | 34 | 13 | 12 |
| 546 | AGVIMESEA | 0 | 0 | 8 | 34 | 4 | 29 |
| 547 | AEGACIEVA | 0 | 0 | 7 | 34 | 8 | 16 |
| 548 | AVLFRNIPA | 2 | 10 | 41 | 33 | 15 | 107 |
| 549 | APKRSNATA | 0 | 6 | 34 | 33 | 18 | 4 |
| 550 | ALRQNLVKA | 1 | 5 | 41 | 33 | 16 | 26 |
| 551 | ALRINNVKA | 3 | 4 | 30 | 33 | 7 | 16 |
| 552 | APRKAGTVA | 1 | 4 | 26 | 33 | 15 | 7 |
| 553 | AQRLNNTKA | 0 | 3 | 13 | 33 | 9 | 28 |
| 554 | APLADLTKA | 0 | 2 | 25 | 33 | 4 | 32 |
| 555 | APLADTVKA | 0 | 1 | 15 | 33 | 13 | 38 |
| 556 | AGRCAIEVA | 0 | 1 | 10 | 33 | 3 | 17 |
| 557 | ARKYQPDLA | 0 | 1 | 22 | 33 | 7 | 12 |
| 558 | ARKIRLDAA | 0 | 0 | 6 | 33 | 2 | 43 |
| 559 | ARRCILSAA | 0 | 0 | 10 | 33 | 7 | 8 |
| 560 | AEVSSPDLA | 0 | 0 | 10 | 33 | 4 | 7 |
| 561 | AGVIMGSEA | 0 | 0 | 7 | 33 | 0 | 7 |
| 562 | AVKYQSDLA | 0 | 0 | 13 | 33 | 8 | 5 |
| 563 | APRQAKVAA | 1 | 0 | 17 | 33 | 12 | 0 |
| 564 | AQMTNQVKA | 7 | 13 | 106 | 32 | 45 | 36 |
| 565 | AGQSNQTRA | 2 | 13 | 71 | 32 | 34 | 12 |
| 566 | APVRAATKA | 1 | 13 | 38 | 32 | 10 | 2 |
| 567 | AKTKSANSA | 0 | 8 | 33 | 32 | 15 | 25 |
| 568 | AFSAHPNKA | 0 | 7 | 59 | 32 | 19 | 14 |
| 569 | ARIKGGVPA | 0 | 7 | 51 | 32 | 10 | 10 |
| 570 | APWFRDNAA | 0 | 6 | 35 | 32 | 20 | 2 |
| 571 | APSKGKSNA | 0 | 5 | 35 | 32 | 9 | 1 |
| 572 | APRTNNTVA | 0 | 4 | 39 | 32 | 11 | 12 |
| 573 | APKTSKSSA | 0 | 4 | 48 | 32 | 18 | 5 |
| 574 | ARKYQAASA | 1 | 3 | 17 | 32 | 3 | 19 |
| 575 | APKANLAKA | 1 | 3 | 32 | 32 | 10 | 6 |
| 576 | AGVIMGPEA | 0 | 1 | 12 | 32 | 5 | 34 |
| 577 | ASYGIRLKA | 0 | 1 | 16 | 32 | 5 | 28 |
| 578 | APRTGATKA | 0 | 1 | 20 | 32 | 6 | 2 |
| 579 | AARGVKVTA | 0 | 1 | 6 | 32 | 5 | 2 |
| 580 | AGSIRSDMA | 0 | 0 | 12 | 32 | 11 | 39 |
| 581 | ARIVILVKA | 0 | 0 | 36 | 32 | 11 | 16 |

TABLE 2-continued

| SEQ ID NO: | Insertion | Parental | hCF round1 | hCF round2 | HCF round3 | Myocyte round 1 | Myocyte round 3 |
|---|---|---|---|---|---|---|---|
| 582 | ALLRIPTKA | 0 | 0 | 25 | 32 | 8 | 7 |
| 583 | AAWGVKVTA | 0 | 0 | 13 | 32 | 6 | 3 |
| 584 | APTKKTAVA | 0 | 13 | 48 | 31 | 13 | 1 |
| 585 | AIMLNQVKA | 5 | 11 | 86 | 31 | 37 | 20 |
| 586 | APGLNYVKA | 2 | 11 | 53 | 31 | 21 | 13 |
| 587 | ARKLHSGPA | 0 | 7 | 20 | 31 | 11 | 23 |
| 588 | AKWKSGASA | 1 | 5 | 28 | 31 | 12 | 11 |
| 589 | AWKAQKTSA | 1 | 5 | 11 | 31 | 9 | 8 |
| 590 | APRTKGTAA | 0 | 4 | 56 | 31 | 23 | 3 |
| 591 | APRHSKVTA | 0 | 3 | 43 | 31 | 14 | 2 |
| 592 | AGTANVTKA | 1 | 2 | 38 | 31 | 24 | 30 |
| 593 | ALLGNMTKA | 0 | 2 | 27 | 31 | 14 | 6 |
| 594 | ARKVHIEIA | 0 | 1 | 2 | 31 | 1 | 18 |
| 595 | AEVSCGPPA | 0 | 1 | 7 | 31 | 8 | 10 |
| 596 | AKAKAGVTA | 0 | 1 | 21 | 31 | 11 | 8 |
| 597 | ALILNATKA | 0 | 0 | 26 | 31 | 5 | 15 |
| 598 | ARSVNLTKA | 0 | 0 | 41 | 31 | 16 | 9 |
| 599 | ASYEYGAKA | 0 | 0 | 27 | 31 | 4 | 9 |
| 600 | ALKYRGPPA | 0 | 0 | 10 | 31 | 1 | 9 |

Example 2: Rationale Design of AAV5 Capsid Proteins with Increase Transduction Efficiency In conjunction with the library-based approach described in Example 1, a rational-design approach was used to identify AAV5 capsid proteins that confer increased transduction efficiency. Surface exposed residues were selected. Substitution of these amino acids were tested in the hCF assay as described in Example 1. The substitutions S651A, T578A, or T582A in the AAV5 capsid resulted in improved human cardiac fibroblast transduction at an multiplicity of infection of 100,000 vg/cell, 72 hours following infection (FIG. 9).

In follow-up experiments, the substitutions identified in this rational-design experiment are tested in combination with one another and in combination with the insertions disclosed in Tables 1 and 2.

Example 3: Comparative Testing of AAVx1 Versus Wild-Type AAV5

An AAV5 capsid having two or three of S651A, T578A, and/or T582A substitutions (AAVx1) was generated. The capsid sequence was as follows:

(SEQ ID NO: 73)
```
MSFVDHPPDWLEEVGEGLREFLGLEAGPPKPKPNQQHQDQARGLVLPGYNY

LGPGNGLDRGEPVNRADEVAREHDISYNEQLEAGDNPYLKYNHADAEFQEK

LADDTSFGGNLGKAVFQAKKRVLEPFGLVEEGAKTAPTGKRIDDHFPKRKK

ARTEEDSKPSTSSDAEAGPSGSQQLQIPAQPASSLGADTMSAGGGGPLGDN

NQGADGVGNASGDWHCDSTWMGDRVVTKSTRTWVLPSYNNHQYREIKSGSV

DGSNANAYFGYSTPWGYFDFNRFHSHWSPRDWQRLINNYWGFRPRSLRVKI

FNIQVKEVTVQDSTTTIANNLTSTVQVFTDDDYQLPYVVGNGTEGCLPAFP

PQVFTLPQYGYATLNRDNTENPTERSSFFCLEYFPSKMLRTGNNFEFTYNF

EEVPFHSSFAPSQNLFKLANPLVDQYLYRFVSTNNTGGVQFNKNLAGRYAN

TYKNWFPGPMGRTQGWNLGSGVNRASVSAFATTNRMELEGASYQVPPQPNG

MTNNLQGSNTYALENTMIFNSQPANPGTTATYLEGNMLITSESETQPVNRV

AYNVGGQMATNNQSST𝐗APA𝐗GTYNLQEIVPGSVWMERDVYLQGPIWAKIP

ETGAHFHPSPAMGGFGLKHPPPMMLIKNTPVPGNITSF𝐗DVPVSSFITQYS

TGQVTVEMEWELKKENSKRWNPEIQYTNNYNDPQFVDFAPDSTGEYRTTRP

IGTRYLTRPL, where X = A, G, V, S, or T
```

To test ability to transduce human cardiac fibroblasts (hCFs), hCFs were infected with AAV5.CAG-GFP or AAVx1 (T582A+S651A) at a MOI ranging from 1,000 to 1,000,000. 48 hours after infection, cells were harvested and GFP expression was quantified using flow cytometry. At all tested MOIs, percent transduction (FIG. 10A), GFP expression (FIG. 10B), and relative transduction (FIG. 10C) were increased compared to the wild-type AAV5 capsid.

The ability of AAVx1 vectors to deliver a functional cargo was tested by generating AAV5 and AAVx1 vectors comprising an expression cassette encoding myocardin and ASCL1 (MyA). The internal deletion of mycocardin MyΔ3 described in Int'l Pat. Appl. No. PCT/US2019/049150 and U.S. Prov. Pat. Appl. No. 62/788,479—each of which is incorporated by reference herein—was used. Strikingly, AAVx1 vector performed on average 9-fold better than AAV5 vector, based on transgene and marker expression at day 7 post-infection (shown in Table 3).

TABLE 3

| | MYOCD | ASCL1 | ACTC1 | CASQ2 | NPPA | PLN | TNNT2 |
|---|---|---|---|---|---|---|---|
| NO INF. | 0.9 | 0.7 | 1.1 | 1.3 | 1.3 | 1.0 | 1.1 |
| | 1.1 | 1.5 | 0.9 | 0.9 | 1.4 | 1.1 | 1.0 |
| AAV5: | 111.3 | 772.4 | 12.5 | 27.9 | 779.2 | 20.0 | 129.0 |
| MYΔ3A + MOI 400K | 117.0 | 772.2 | 11.8 | 29.5 | 512.2 | 18.0 | 120.0 |
| AAV5: | 219.0 | 1345.2 | 17.4 | 40.6 | 756.9 | 35.5 | 200.9 |
| MYΔ3A + MOI 1.2M | 176.2 | 1230.6 | 17.1 | 44.9 | 922.6 | 30.5 | 171.6 |
| AAVx1: | 897.5 | 5743.7 | 119.6 | 321.9 | 6165.3 | 143.5 | 1010.5 |
| MYΔ3A + MOI 400K | 811.0 | 5619.1 | 103.8 | 288.4 | 5875.2 | 127.9 | 972.3 |
| AAVx1: | 1680.1 | 11924.0 | 188.8 | 587.3 | 10753.4 | 234.1 | 2013.0 |
| MYΔ3A + MOI 1.2M | 1683.6 | 11225.0 | 196.2 | 490.3 | 10787.2 | 246.7 | 1795.3 |

Example 4: In Vivo Transduction of Cardiac Tissue with AAVx1

Testing in Mice

To evaluate in vivo transduction, AAV5 or AAVx1 (T582A+S651A) capsid was used to deliver an expression cassette encoding a GFP reporter in mice using the LAD-ligation mouse model of myocardial infarction (MI), with injection of the AAV vector performed epicardially at the time of injury. A single vector dose of $1.2 \times 10^{11}$ genome copies (GC) was delivered to the heart of each subject by intracardiac injection. Seven days following injection, animals were sacrificed and their hearts dissociated by enzymatic digestion. Dissociated cells were stained with an endothelial marker (CD31) and fibroblast marker (Thy-1) and sorted using fluorescence activated cell sorting (FACs). GFP+, Thy-1+ and CD31− cells were classified as transduced cardiac fibroblasts, while, GFP−, Thy-1+ and CD31− cells were classified as non-transduced cardiac fibroblasts. The number of transduced cells were normalized to AAV5. As shown in FIG. 11, in vivo transduction of cardiac fibroblast cells (CF) was more than 4-fold greater using AAVx1 vector than AAV5 vector.

For functional in vivo testing, AAVx1 (T582A+S651A) capsid was used to deliver an expression cassette encoding myocardin and ASCL1 (MyA). The AAVx1 vector was tested in mice using the LAD-ligation mouse model of myocardial infarction (MI), with injection of the AAV vector performed epicardially at the time of injury. A single vector dose of $1.2 \times 10^{11}$ genome copies (GC) was delivered to the heart of each subject by intracardiac injection.

Efficacy was assessed by echocardiography at 2, 4, 6, and 8 weeks post-injection. The AAVx1 vector significantly preserved cardiac function (ejection fraction) compared to the GFP-encoding control (FIG. 12).

Testing in Pigs

The AAVx1 vector was further tested in a pig myocardial infarction (MI) model. MyA was packaged into AAVx1 capsid and injected epicardially into the border zone of pig hearts 28 days after a 90-minute balloon occlusion to introduce ischemic injury. In parallel, infarcted pigs were also injected with formulation buffer, so that each group consisted of ten animals. Echocardiography was performed 3-weeks, 5-weeks, 7-weeks and 9-weeks post-injection. Pigs that received AAVx1 vector demonstrated significant improvement in ejection fraction relative to control 5-weeks, 7-weeks and 9-weeks post-injection (FIG. 13). Thus, treatment with the an AAVx1 vector resulted in an average 10% improvement in cardiac performance above pre-dose baseline.

SEQUENCE LISTING (1107 sequences)

SEQ ID NO: 1 - protein, 724 aa, Dependoparvovirus adeno associated virus 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 2 - protein, 350 aa, Dependoparvovirus adeno associated virus 5
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQ

SEQ ID NO: 3 - protein, 150 aa, Dependoparvovirus adeno associated virus 5
SSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 4 - protein, 509 aa, Artificial Sequence
  Recombinant Dependoparvovirus adeno associated virus 5 Capsid Protein VP3
  MISC_FEATURE (351)..(359): Xaa can be any naturally occurring amino acid
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQXXXXXXXXXSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 5 - protein, 509 aa, Artificial Sequence
  Recombinant Dependoparvovirus adeno associated virus 5 Capsid Protein VP3
  MISC_FEATURE (352)..(358): Xaa can be any naturally occurring amino acid
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAXXXXXXXASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 6 - DNA, 87 bp, Artificial Sequence
  Oligonucleotide primer P1
  misc_feature (34)..(35): n is a, c, g, or t
  misc_feature (37)..(38): n is a, c, g, or t
  misc_feature (40)..(41): n is a, c, g, or t
  misc_feature (43)..(44): n is a, c, g, or t
  misc_feature (46)..(47): n is a, c, g, or t
  misc_feature (49)..(50): n is a, c, g, or t
  misc_feature (52)..(53): n is a, c, g, or t
gtcggcgggcagatggccaccaacaaccaggccnnknnknnknnknnknnknnkgccagctccaccactgcccccgcgaccggcacg

SEQ ID NO: 7 - DNA, 40 bp, Artificial Sequence
  Oligonucleotide primer P2
tccccagcatgagcgatgcattttattgagggtatgcgac

SEQ ID NO: 8 - DNA, 44 bp, Artificial Sequence
  Oligonucleotide primer P3
ccatcgacgtcagacgcggaagcttcgatcaactacgcagacag

SEQ ID NO: 9 - protein, 733 aa, Artificial Sequence
  AAV5.CR2
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 10 - protein, 733 aa, Artificial Sequence
  AAV5.CR5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 11 - protein, 733 aa, Artificial Sequence
  AAV5.CR8
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKHHGLEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 12 - protein, 733 aa, Artificial Sequence
  AAV5.CR17
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 13 - protein, 733 aa, Artificial Sequence
  AAV5.CR18
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALKYHGPPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 14 - protein, 733 aa, Artificial Sequence
  AAV5.CR19
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQGDMASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 15 - protein, 733 aa, Artificial Sequence
  AAV5.CR20
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKFHSTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 16 - protein, 733 aa, Artificial Sequence
  AAV5.CR21
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGTNVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 17 - protein, 733 aa, Artificial Sequence
  AAV5.CR22
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKMHMPDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 18 - protein, 733 aa, Artificial Sequence
  AAV5.CR23
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLKKIVQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 19 - protein, 733 aa, Artificial Sequence
  AAV5.CR24
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLGKKTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 20 - protein, 733 aa, Artificial Sequence
  AAV5.CR25
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRGVKVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 21 - protein, 733 aa, Artificial Sequence
  AAV5.CR26
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLAKSKSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 22 - protein, 733 aa, Artificial Sequence
  AAV5.CR27
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTKGAVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 23 - protein, 733 aa, Artificial Sequence
  AAV5.CR28
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSGRKATASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 24 - protein, 724 aa, Artificial Sequence
  AAV5.K251R
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIRSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 25 - protein, 724 aa, Artificial Sequence
  AAV5.S485A
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRAAVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 26 - protein, 724 aa, Artificial Sequence
  AAV5.S651A
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFADVPVSSFITQYSTGQVTVEMEWELKKENSKRWNPEIQYTNNYNDPQFVDFAPDSTGEYRTTRPIGTRYLTRPL

SEQ ID NO: 27 - protein, 724 aa, Artificial Sequence
  AAV5.T578A
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTAAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 28 - protein, 724 aa, Artificial Sequence
  AAV5.T582A
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPAAGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 29 - protein, 724 aa, Artificial Sequence
  AAV5.Y709F
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEFRTTRPIGTRYLTRPL

SEQ ID NO: 30 - protein, 724 aa, Artificial Sequence
  AAV5.Y693F
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNFNDPQFVDFAPDSTGEYRTTRPIGTRYLTRPL

SEQ ID NO: 31 - protein, 733 aa, Artificial Sequence
  AAV5.CR17(444) andT591A
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPAAGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 32 - protein, 733 aa, Artificial Sequence
  AAV5.CR17(575) and T591A
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNTVKASSTTAPAAGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 33 - protein, 733 aa, Artificial Sequence
  AAV5.CR17(575) and T591A and S660A
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNTVKASSTTAPAAGTYNLQEIVPGSVWMERDVYLQGPIWAKIPETGAHFHPSPAMGGFGLKHPPPMMLIKNTPVPGNITSFADVPVSSFITQYSTGQVTVEMEWELKKENSKRWNPEIQYTNNYNDPQFVDFAPDSTGEYRTTRPIGTRYLTRPL

SEQ ID NO: 34 - protein, 724 aa, Artificial Sequence
  AAV5.T582A and S651A
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPAAGTYNLQEIVPGSVWMERDVYLQGPIWAKIPETGAHFHPSPAMGGFGLKHPPPMMLIKNTPVPGNITSFADVPVSSFITQYSTGQVTVEMEWELKKENSKRWNPEIQYTNNYNDPQFVDFAPDSTGEYRTTRPIGTRYLTRPL

SEQ ID NO: 35-50 - skipped (16 entries)

SEQ ID NO: 51 - DNA, 2202 bp, Artificial Sequence
  Recombinant polynucleotide engineered capsid AAV5.CR2
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcccggaaggtgcatattgaggtggccagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 52 - DNA, 2202 bp, Artificial Sequence
  Recombinant polynucleotide engineered capsid AAV5.CR5
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcgcgaaagtatcagagtgatctcgctagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 53 - DNA, 2202 bp, Artificial Sequence
  Recombinant polynucleotide engineered capsid AAV5.CR8
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcacggaagcatcatggccttgaagcgagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 54 - DNA, 2202 bp, Artificial Sequence
  Recombinant polynucleotide engineered capsid AAV5.CR17
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcaccgttgaccaatacagtaaaggcaagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 55 - DNA, 2202 bp, Artificial Sequence
  Recombinant polynucleotide engineered capsid AAV5.CR18
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcactcaaataccacggacctccagcgagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 56 - DNA, 2202 bp, Artificial Sequence
  Recombinant polynucleotide engineered capsid AAV5.CR19
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcaagaaaatatcaaggagatatggccagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 57 - DNA, 2202 bp, Artificial Sequence
  Recombinant polynucleotide engineered capsid AAV5.CR20
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcgcgcaagtttcactcaacggatgcgagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 58 - DNA, 2202 bp, Artificial Sequence
  Recombinant polynucleotide engineered capsid AAV5.CR21
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcaccgggaaccaacgtgacgaaggcaagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 59 - DNA, 2202 bp, Artificial Sequence
  Recombinant polynucleotide engineered capsid AAV5.CR22
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcccgtaagatgcatatgcctgatgccagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 60 - DNA, 2202 bp, Artificial Sequence
  Recombinant polynucleotide engineered capsid AAV5.CR23
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggccccattgaaaaaaatcgtccaagcaagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 61 - DNA, 2202 bp, Artificial Sequence
  Recombinant polynucleotide engineered capsid AAV5.CR24
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggctcctcttggcaaaaaaacctcagcaagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 62 - DNA, 2202 bp, Artificial Sequence
  Recombinant polynucleotide engineered capsid AAV5.CR25
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcaccccgaggagtgaaggtcacggctagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 63 - DNA, 2202 bp, Artificial Sequence
  Recombinant polynucleotide engineered capsid AAV5.CR26
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggctcctcttgctaaatctaagtccgccagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 64 - DNA, 2202 bp, Artificial Sequence
  Recombinant polynucleotide engineered capsid AAV5.CR27
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggcgccgcgaactaaaggtgctgtcgccagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 65 - DNA, 2202 bp, Artificial Sequence
  Recombinant polynucleotide engineered capsid AAV5.CR28
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccaggccccaagtggacggaaggctactgcaagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 66 - DNA, 2175 bp, Artificial Sequence
  Recombinant polynucleotide engineered capsid AAV5.K251R
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaggagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 67 - DNA, 2175 bp, Artificial Sequence
  Recombinant polynucleotide engineered capsid AAV5.S485A
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccgccgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 68 - DNA, 2175 bp, Artificial Sequence
  Recombinant polynucleotide engineered capsid AAV5.S651A
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttcgccgacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 69 - DNA, 2175 bp, Artificial Sequence
  Recombinant polynucleotide engineered capsid AAV5.T578A
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccgccgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 70 - DNA, 2175 bp, Artificial Sequence
  Recombinant polynucleotide engineered capsid AAV5.T582A
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcggccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 71 - DNA, 2175 bp, Artificial Sequence
  Recombinant polynucleotide engineered capsid AAV5.Y709F
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaattcagaaccaccagacctatcggaacccgataccttacccgacccctttaa

SEQ ID NO: 72 - DNA, 2175 bp, Artificial Sequence
  Recombinant polynucleotide engineered capsid AAV5.Y693F
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaacttcaacgacccccagtttgtggactttgccccggacagcaccggggaatacagaaccaccagacctatcggaacccgataccttacccgacccctttaa

SEQ ID NO: 73 - protein, 724 aa, Artificial Sequence
  mutated AAV5 capsid protein
  MISC_FEATURE (578)..(578): Xaa is Ala, Gly, Val, Ser or Thr
  MISC_FEATURE (582)..(582): Xaa is Ala, Gly, Val, Ser or Thr
  MISC_FEATURE (651)..(651): Xaa is Ala, Gly, Val, Ser or Thr
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTXAPAXGTYNLQEIVPGSVWMERDVYLQGPIWAKIPETGAHFHPSPAMGGFGLKHPPPMMLIKNTPVPGNITSFXDVPVSSFITQYSTGQVTVEMEWELKKENSKRWNPEIQYTNNYNDPQFVDFAPDSTGEYRTTRPIGTRYLTRPL

SEQ ID NO: 74 - protein, 724 aa, Artificial Sequence; identical to SEQ ID NO: 27
  mutated AAV5 capsid protein

SEQ ID NO: 75 - protein, 724 aa, Artificial Sequence; identical to SEQ ID NO: 28
  mutated AAV5 capsid protein

SEQ ID NO: 76 - protein, 724 aa, Artificial Sequence; identical to SEQ ID NO: 26
  mutated AAV5 capsid protein

SEQ ID NO: 77 - protein, 724 aa, Artificial Sequence
  mutated AAV5 capsid protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTAAPAAGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 78 - protein, 724 aa, Artificial Sequence
  mutated AAV5 capsid protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTAAPATGTYNLQEIVPGSVWMERDVYLQGPIWAKIPETGAHFHPSPAMGGFGLKHPPPMMLIKNTPVPGNITSFADVPVSSFITQYSTGQVTVEMEWELKKENSKRWNPEIQYTNNYNDPQFVDFAPDSTGEYRTTRPIGTRYLTRPL

SEQ ID NO: 79 - protein, 724 aa, Artificial Sequence; identical to SEQ ID NO: 34
  mutated AAV5 capsid protein

SEQ ID NO: 80 - protein, 724 aa, Artificial Sequence
  mutated AAV5 capsid protein
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTAAPAAGTYNLQEIVPGSVWMERDVYLQGPIWAKIPETGAHFHPSPAMGGFGLKHPPPMMLIKNTPVPGNITSFADVPVSSFITQYSTGQVTVEMEWELKKENSKRWNPEIQYTNNYNDPQFVDFAPDSTGEYRTTRPIGTRYLTRPL

SEQ ID NO: 81 - protein, 7 aa, Artificial Sequence
  Artificial peptide sequence
RKVHIEV

SEQ ID NO: 82 - protein, 7 aa, Artificial Sequence
  Artificial peptide sequence
RKYQSDL

SEQ ID NO: 83 - protein, 7 aa, Artificial Sequence
  Artificial peptide sequence
PLTNTVK

SEQ ID NO: 84 - protein, 7 aa, Artificial Sequence
  Artificial peptide sequence
LKYHGPP

SEQ ID NO: 85 - protein, 7 aa, Artificial Sequence
  Artificial peptide sequence
RKYQGDM

SEQ ID NO: 86 - protein, 7 aa, Artificial Sequence
  Artificial peptide sequence
RKFHSTD

SEQ ID NO: 87 - protein, 7 aa, Artificial Sequence
  Artificial peptide sequence
RKHHGLE

SEQ ID NO: 88 - protein, 7 aa, Artificial Sequence
  Artificial peptide sequence
PGTNVTK

SEQ ID NO: 89 - protein, 7 aa, Artificial Sequence
  Artificial peptide sequence
RKMHMPD

SEQ ID NO: 90 - protein, 7 aa, Artificial Sequence
  Artificial peptide sequence
PLKKIVQ

SEQ ID NO: 91 - protein, 7 aa, Artificial Sequence
  Artificial peptide sequence
PLGKKTS

SEQ ID NO: 92 - protein, 7 aa, Artificial Sequence
  Artificial peptide sequence
PRGVKVT

SEQ ID NO: 93 - protein, 7 aa, Artificial Sequence
  Artificial peptide sequence
PLAKSKS

SEQ ID NO: 94 - protein, 7 aa, Artificial Sequence
  Artificial peptide sequence
PRTKGAV

SEQ ID NO: 95 - protein, 7 aa, Artificial Sequence
  Artificial peptide sequence
PSGRKAT

SEQ ID NO: 96-99 - skipped (4 entries)

SEQ ID NO: 100 - protein, 8 aa, Artificial Sequence
  Artificial peptide sequence
  MISC_FEATURE (2)..(7): Xaa can be any naturally occurring amino acid
AXXXXXXA

SEQ ID NO: 101 - protein, 9 aa, Artificial Sequence
  Artificial peptide sequence
ARKVHIEVA

SEQ ID NO: 102 - protein, 9 aa, Artificial Sequence
  Artificial peptide sequence
ARKYQSDLA

SEQ ID NO: 103 - protein, 9 aa, Artificial Sequence
  Artificial peptide sequence
APLTNTVKA

SEQ ID NO: 104 - protein, 9 aa, Artificial Sequence
  Artificial peptide sequence
ALKYHGPPA

SEQ ID NO: 105 - protein, 9 aa, Artificial Sequence
  Artificial peptide sequence
ARKYQGDMA

SEQ ID NO: 106 - protein, 9 aa, Artificial Sequence
  Artificial peptide sequence
ARKFHSTDA

SEQ ID NO: 107 - protein, 9 aa, Artificial Sequence
  Artificial peptide sequence
ARKHHGLEA

SEQ ID NO: 108 - protein, 9 aa, Artificial Sequence
  Artificial peptide sequence
APGTNVTKA

SEQ ID NO: 109 - protein, 9 aa, Artificial Sequence
  Artificial peptide sequence
ARKMHMPDA

SEQ ID NO: 110 - protein, 9 aa, Artificial Sequence
  Artificial peptide sequence
APLKKIVQA

SEQ ID NO: 111 - protein, 9 aa, Artificial Sequence
  Artificial peptide sequence
APLGKKTSA

SEQ ID NO: 112 - protein, 9 aa, Artificial Sequence
  Artificial peptide sequence
APRGVKVTA

SEQ ID NO: 113 - protein, 9 aa, Artificial Sequence
  Artificial peptide sequence
APLAKSKSA

SEQ ID NO: 114 - protein, 9 aa, Artificial Sequence
  Artificial peptide sequence
APRTKGAVA

SEQ ID NO: 115 - protein, 9 aa, Artificial Sequence
  Artificial peptide sequence
APSGRKATA

SEQ ID NO: 116 - protein, 9 aa, Artificial Sequence
  Artificial peptide sequence
ARKIHLDAA

SEQ ID NO: 117 - protein, 9 aa, Artificial Sequence
  Artificial peptide sequence
APYHNATKA

SEQ ID NO: 118 - protein, 9 aa, Artificial Sequence
  Artificial peptide sequence
ARKWHDTEA

SEQ ID NO: 119 - protein, 9 aa, Artificial Sequence
  Artificial peptide sequence
APVANVTKA

SEQ ID NO: 120 - protein, 9 aa, Artificial Sequence
  Artificial peptide sequence
ARKVHIGVA

SEQ ID NO: 121 - protein, 9 aa, Artificial Sequence
  Artificial peptide sequence
APLNNSVKA

SEQ ID NO: 122 - protein, 9 aa, Artificial Sequence
  Artificial peptide sequence
ARRYHGSEA

SEQ ID NO: 123 - protein, 9 aa, Artificial Sequence
  Artificial peptide sequence
AYGHPNVIA

SEQ ID NO: 124 - protein, 9 aa, Artificial Sequence
  Artificial peptide sequence
APFTNSTKA

SEQ ID NO: 125 - protein, 9 aa, Artificial Sequence
  Artificial peptide sequence
ARKVQVGVA

SEQ ID NO: 126 - protein, 9 aa, Artificial Sequence
  Artificial peptide sequence
AGRCILRVA

SEQ ID NO: 127 - protein, 9 aa, Artificial Sequence
  Artificial peptide sequence
AKIKTGVPA

SEQ ID NO: 128 - protein, 9 aa, Artificial Sequence
  Artificial peptide sequence
AWHNSYPHA

SEQ ID NO: 129 - protein, 9 aa, Artificial Sequence
  Artificial peptide sequence
APSVNLTKA

SEQ ID NO: 130 - protein, 9 aa, Artificial Sequence
  Artificial peptide sequence
APLSNLVKA

SEQ ID NO: 131 - protein, 9 aa, Artificial Sequence
  Artificial peptide sequence
ARKFHTETA

SEQ ID NO: 132 - protein, 9 aa, Artificial Sequence
  Artificial peptide sequence
AGRFILDAA

SEQ ID NO: 133 - protein, 9 aa, Artificial Sequence
  Artificial peptide sequence
AVKQNQTKA

SEQ ID NO: 134 - protein, 9 aa, Artificial Sequence
  Artificial peptide sequence
AVRSNKVAA

SEQ ID NO: 135 - protein, 9 aa, Artificial Sequence
  Artificial peptide sequence
AGRCILRWA

SEQ ID NO: 136 - protein, 9 aa, Artificial Sequence
  Artificial peptide sequence
ARKWQQSEA

SEQ ID NO: 137 - protein, 9 aa, Artificial Sequence
  Artificial peptide sequence
APLKNGTKA

SEQ ID NO: 138 - protein, 9 aa, Artificial Sequence
  Artificial peptide sequence
AGLKNAVKA

SEQ ID NO: 139 - protein, 9 aa, Artificial Sequence
  Artificial peptide sequence
APAINHVKA

SEQ ID NO: 140 - protein, 9 aa, Artificial Sequence
  Artificial peptide sequence
AGVLSNRIA

SEQ ID NO: 141 - protein, 9 aa, Artificial Sequence
  Artificial peptide sequence
APLANTAKA

SEQ ID NO: 142 - protein, 9 aa, Artificial Sequence
  Artificial peptide sequence
ARRWHGDEA

SEQ ID NO: 143 - protein, 9 aa, Artificial Sequence
  Artificial peptide sequence
APLRNANKA

SEQ ID NO: 144 - protein, 9 aa, Artificial Sequence
  Artificial peptide sequence
APLTNLIKA

SEQ ID NO: 145 - protein, 9 aa, Artificial Sequence
  Artificial peptide sequence
ARKLQVGSA

SEQ ID NO: 146 - protein, 9 aa, Artificial Sequence
  Artificial peptide sequence
AEGAYIEVA

SEQ ID NO: 147 - protein, 9 aa, Artificial Sequence
  Artificial peptide sequence
APMANLVKA

SEQ ID NO: 148 - protein, 9 aa, Artificial Sequence
  Artificial peptide sequence
AKTVNATKA

SEQ ID NO: 149 - protein, 9 aa, Artificial Sequence
  Artificial peptide sequence
APVTKKASA

SEQ ID NO: 150 - protein, 9 aa, Artificial Sequence
  Artificial peptide sequence
APMPNSAKA

SEQ ID NO: 151 - protein, 9 aa, Artificial Sequence
  Artificial peptide sequence
AGSIQSDLA

SEQ ID NO: 152 - protein, 9 aa, Artificial Sequence
  Artificial peptide sequence
ALLRNTVKA

SEQ ID NO: 153 - protein, 9 aa, Artificial Sequence
  Artificial peptide sequence
AGHLSNHIA

SEQ ID NO: 154 - protein, 9 aa, Artificial Sequence
  Artificial peptide sequence
APMSNRATA

SEQ ID NO: 155 - protein, 9 aa, Artificial Sequence
  Artificial peptide sequence
ARKYQLDLA

SEQ ID NO: 156 - protein, 9 aa, Artificial Sequence
  Artificial peptide sequence
APHSNSSKA

SEQ ID NO: 157 - protein, 9 aa, Artificial Sequence
  Artificial peptide sequence
AGLGNAVKA

SEQ ID NO: 158 - protein, 9 aa, Artificial Sequence
  Artificial peptide sequence
AGSIRGDMA

SEQ ID NO: 159 - protein, 9 aa, Artificial Sequence
  Artificial peptide sequence
ALLRIRLKA

SEQ ID NO: 160 - protein, 9 aa, Artificial Sequence
  Artificial peptide sequence
ARKVYIEVA

SEQ ID NO: 161 - protein, 9 aa, Artificial Sequence
  Artificial peptide sequence
AWKVHIEVA

SEQ ID NO: 162 - protein, 9 aa, Artificial Sequence
  Artificial peptide sequence
APRSAKPVA

SEQ ID NO: 163 - protein, 9 aa, Artificial Sequence
  Artificial peptide sequence
APLANLTKA

SEQ ID NO: 164 - protein, 9 aa, Artificial Sequence
  Artificial peptide sequence
APRGSAVKA

SEQ ID NO: 165 - protein, 9 aa, Artificial Sequence
  Artificial peptide sequence
AGRLHIEVA

SEQ ID NO: 166 - protein, 9 aa, Artificial Sequence
  Artificial peptide sequence
APLRISTKA

SEQ ID NO: 167 - protein, 9 aa, Artificial Sequence
  Artificial peptide sequence
ARKWQSHEA

SEQ ID NO: 168 - protein, 9 aa, Artificial Sequence
  Artificial peptide sequence
APKVHIEVA

SEQ ID NO: 169 - protein, 9 aa, Artificial Sequence
  Artificial peptide sequence
ARRCILRWA

SEQ ID NO: 170 - protein, 9 aa, Artificial Sequence
  Artificial peptide sequence
AKTKSGINA

SEQ ID NO: 171 - protein, 9 aa, Artificial Sequence
  Artificial peptide sequence
APSINSVKA

SEQ ID NO: 172 - protein, 9 aa, Artificial Sequence
  Artificial peptide sequence
APSLNLVKA

SEQ ID NO: 173 - protein, 9 aa, Artificial Sequence
  Artificial peptide sequence
APLGNMTKA

SEQ ID NO: 174 - protein, 9 aa, Artificial Sequence
  Artificial peptide sequence
ALYHNATKA

SEQ ID NO: 175 - protein, 9 aa, Artificial Sequence
  Artificial peptide sequence
ALLSNLVKA

SEQ ID NO: 176 - protein, 9 aa, Artificial Sequence
  Artificial peptide sequence
ALRHKSNNA

SEQ ID NO: 177 - protein, 9 aa, Artificial Sequence
  Artificial peptide sequence
APRKSNASA

SEQ ID NO: 178 - protein, 9 aa, Artificial Sequence
  Artificial peptide sequence
APFSNSSKA

SEQ ID NO: 179 - protein, 9 aa, Artificial Sequence
  Artificial peptide sequence
AGRCILGVA

SEQ ID NO: 180 - protein, 9 aa, Artificial Sequence
  Artificial peptide sequence
APASNSSRA

SEQ ID NO: 181 - protein, 9 aa, Artificial Sequence
  Artificial peptide sequence
AGKYQSDLA

SEQ ID NO: 182 - protein, 9 aa, Artificial Sequence
  Artificial peptide sequence
AGRCILEVA

SEQ ID NO: 183 - protein, 9 aa, Artificial Sequence
  Artificial peptide sequence
ALTQNSTKA

SEQ ID NO: 184 - protein, 9 aa, Artificial Sequence
  Artificial peptide sequence
ALIANATKA

SEQ ID NO: 185 - protein, 9 aa, Artificial Sequence
  Artificial peptide sequence
ARKFHAMEA

SEQ ID NO: 186 - protein, 9 aa, Artificial Sequence
  Artificial peptide sequence
APLRSTVKA

SEQ ID NO: 187 - protein, 9 aa, Artificial Sequence
  Artificial peptide sequence
ARYSPNSVA

SEQ ID NO: 188 - protein, 9 aa, Artificial Sequence
  Artificial peptide sequence
AGKVHIEVA

SEQ ID NO: 189 - protein, 9 aa, Artificial Sequence
  Artificial peptide sequence
AGSISPDLA

SEQ ID NO: 190 - protein, 9 aa, Artificial Sequence
  Artificial peptide sequence
ARKVHIEAA

SEQ ID NO: 191 - protein, 9 aa, Artificial Sequence
  Artificial peptide sequence
ALRMNSVKA

SEQ ID NO: 192 - protein, 9 aa, Artificial Sequence
  Artificial peptide sequence
APAHKVKAA

SEQ ID NO: 193 - protein, 9 aa, Artificial Sequence
  Artificial peptide sequence
ACKHHGLEA

SEQ ID NO: 194 - protein, 9 aa, Artificial Sequence
  Artificial peptide sequence
AGLSNATKA

SEQ ID NO: 195 - protein, 9 aa, Artificial Sequence
  Artificial peptide sequence
APLANRTSA

SEQ ID NO: 196 - protein, 9 aa, Artificial Sequence
  Artificial peptide sequence
AGRCILRCA

SEQ ID NO: 197 - protein, 9 aa, Artificial Sequence
  Artificial peptide sequence
AQEDSFDAA

SEQ ID NO: 198 - protein, 9 aa, Artificial Sequence
  Artificial peptide sequence
AVSIMGLEA

SEQ ID NO: 199 - protein, 9 aa, Artificial Sequence
  Artificial peptide sequence
APGTNLIKA

SEQ ID NO: 200 - protein, 9 aa, Artificial Sequence
  Artificial peptide sequence
ATSGNSVRA

SEQ ID NO: 201 - protein, 9 aa, Artificial Sequence
  Artificial peptide sequence
ARFPVGSLA

SEQ ID NO: 202 - protein, 9 aa, Artificial Sequence
  Artificial peptide sequence
APRVTKAAA

SEQ ID NO: 203 - protein, 9 aa, Artificial Sequence
  Artificial peptide sequence
AGSFHSTDA

SEQ ID NO: 204 - protein, 9 aa, Artificial Sequence
  Artificial peptide sequence
AHKALVHGA

SEQ ID NO: 205 - protein, 9 aa, Artificial Sequence
  Artificial peptide sequence
ALLTNTVKA

SEQ ID NO: 206 - protein, 9 aa, Artificial Sequence
  Artificial peptide sequence
ALLKKIVQA

SEQ ID NO: 207 - protein, 9 aa, Artificial Sequence
  Artificial peptide sequence
APRDNRTSA

SEQ ID NO: 208 - protein, 9 aa, Artificial Sequence
  Artificial peptide sequence
APRVNKTVA

SEQ ID NO: 209 - protein, 9 aa, Artificial Sequence
  Artificial peptide sequence
AGIMSNKIA

SEQ ID NO: 210 - protein, 9 aa, Artificial Sequence
  Artificial peptide sequence
ALFTNTVKA

SEQ ID NO: 211 - protein, 9 aa, Artificial Sequence
  Artificial peptide sequence
APRTNITKA

SEQ ID NO: 212 - protein, 9 aa, Artificial Sequence
  Artificial peptide sequence
AGSFASTDA

SEQ ID NO: 213 - protein, 9 aa, Artificial Sequence
  Artificial peptide sequence
APQSNVTKA

SEQ ID NO: 214 - protein, 9 aa, Artificial Sequence
  Artificial peptide sequence
AWRYHGSEA

SEQ ID NO: 215 - protein, 9 aa, Artificial Sequence
  Artificial peptide sequence
APHKATKSA

SEQ ID NO: 216 - protein, 9 aa, Artificial Sequence
  Artificial peptide sequence
APLTNTAKA

SEQ ID NO: 217 - protein, 9 aa, Artificial Sequence
  Artificial peptide sequence
APLGNTAKA

SEQ ID NO: 218 - protein, 9 aa, Artificial Sequence
  Artificial peptide sequence
APLDNRLKA

SEQ ID NO: 219 - protein, 9 aa, Artificial Sequence
  Artificial peptide sequence
AGRCILSAA

SEQ ID NO: 220 - protein, 9 aa, Artificial Sequence
  Artificial peptide sequence
APLINVVKA

SEQ ID NO: 221 - protein, 9 aa, Artificial Sequence
  Artificial peptide sequence
AGRCILKLA

SEQ ID NO: 222 - protein, 9 aa, Artificial Sequence
  Artificial peptide sequence
APISGKNKA

SEQ ID NO: 223 - protein, 9 aa, Artificial Sequence
  Artificial peptide sequence
AKSKAGQVA

SEQ ID NO: 224 - protein, 9 aa, Artificial Sequence
  Artificial peptide sequence
AGKIHLDAA

SEQ ID NO: 225 - protein, 9 aa, Artificial Sequence
  Artificial peptide sequence
AGHTNSVKA

SEQ ID NO: 226 - protein, 9 aa, Artificial Sequence
  Artificial peptide sequence
ALFTNSTKA

SEQ ID NO: 227 - protein, 9 aa, Artificial Sequence
  Artificial peptide sequence
APSTNTVKA

SEQ ID NO: 228 - protein, 9 aa, Artificial Sequence
  Artificial peptide sequence
ARKIHLMRA

SEQ ID NO: 229 - protein, 9 aa, Artificial Sequence
  Artificial peptide sequence
APAPNSVKA

SEQ ID NO: 230 - protein, 9 aa, Artificial Sequence
  Artificial peptide sequence
AGITGNKIA

SEQ ID NO: 231 - protein, 9 aa, Artificial Sequence
  Artificial peptide sequence
AGRVHIEVA

SEQ ID NO: 232 - protein, 9 aa, Artificial Sequence
  Artificial peptide sequence
ARKVHIEGA

SEQ ID NO: 233 - protein, 9 aa, Artificial Sequence
  Artificial peptide sequence
AKKLNNSIA

SEQ ID NO: 234 - protein, 9 aa, Artificial Sequence
  Artificial peptide sequence
AGSISRILA

SEQ ID NO: 235 - protein, 9 aa, Artificial Sequence
  Artificial peptide sequence
AGYMGNHIA

SEQ ID NO: 236 - protein, 9 aa, Artificial Sequence
  Artificial peptide sequence
AVSIMGWEA

SEQ ID NO: 237 - protein, 9 aa, Artificial Sequence
  Artificial peptide sequence
AVVSNAARA

SEQ ID NO: 238 - protein, 9 aa, Artificial Sequence
  Artificial peptide sequence
APRAKVVQA

SEQ ID NO: 239 - protein, 9 aa, Artificial Sequence
  Artificial peptide sequence
APLGNTVRA

SEQ ID NO: 240 - protein, 9 aa, Artificial Sequence
  Artificial peptide sequence
APRTTTVKA

SEQ ID NO: 241 - protein, 9 aa, Artificial Sequence
  Artificial peptide sequence
APGTDVTKA

SEQ ID NO: 242 - protein, 9 aa, Artificial Sequence
  Artificial peptide sequence
ALGRNVTKA

SEQ ID NO: 243 - protein, 9 aa, Artificial Sequence
  Artificial peptide sequence
ALKHHGPPA

SEQ ID NO: 244 - protein, 9 aa, Artificial Sequence
  Artificial peptide sequence
APLRIPTKA

SEQ ID NO: 245 - protein, 9 aa, Artificial Sequence
  Artificial peptide sequence
AQATNTVRA

SEQ ID NO: 246 - protein, 9 aa, Artificial Sequence
  Artificial peptide sequence
ASTGNSTRA

SEQ ID NO: 247 - protein, 9 aa, Artificial Sequence
  Artificial peptide sequence
APMHNGIKA

SEQ ID NO: 248 - protein, 9 aa, Artificial Sequence
  Artificial peptide sequence
ARKVHTEVA

SEQ ID NO: 249 - protein, 9 aa, Artificial Sequence
  Artificial peptide sequence
AMKYHGPAA

SEQ ID NO: 250 - protein, 9 aa, Artificial Sequence
  Artificial peptide sequence
ALHLNSIKA

SEQ ID NO: 251 - protein, 9 aa, Artificial Sequence
  Artificial peptide sequence
APSINTIKA

SEQ ID NO: 252 - protein, 9 aa, Artificial Sequence
  Artificial peptide sequence
AGRCILSVA

SEQ ID NO: 253 - protein, 9 aa, Artificial Sequence
  Artificial peptide sequence
AKAKAGVAA

SEQ ID NO: 254 - protein, 9 aa, Artificial Sequence
  Artificial peptide sequence
APSSNAAKA

SEQ ID NO: 255 - protein, 9 aa, Artificial Sequence
  Artificial peptide sequence
ARKVQSGVA

SEQ ID NO: 256 - protein, 9 aa, Artificial Sequence
  Artificial peptide sequence
AGKYQGDMA

SEQ ID NO: 257 - protein, 9 aa, Artificial Sequence
  Artificial peptide sequence
AMVIPNVIA

SEQ ID NO: 258 - protein, 9 aa, Artificial Sequence
  Artificial peptide sequence
AGVKHNSIA

SEQ ID NO: 259 - protein, 9 aa, Artificial Sequence
  Artificial peptide sequence
ARKHQSDLA

SEQ ID NO: 260 - protein, 9 aa, Artificial Sequence
  Artificial peptide sequence
AKQPNAVKA

SEQ ID NO: 261 - protein, 9 aa, Artificial Sequence
  Artificial peptide sequence
AFTHPNSVA

SEQ ID NO: 262 - protein, 9 aa, Artificial Sequence
  Artificial peptide sequence
APRTSTVKA

SEQ ID NO: 263 - protein, 9 aa, Artificial Sequence
  Artificial peptide sequence
ARVGVKVTA

SEQ ID NO: 264 - protein, 9 aa, Artificial Sequence
  Artificial peptide sequence
AEGVHIEVA

SEQ ID NO: 265 - protein, 9 aa, Artificial Sequence
  Artificial peptide sequence
ASKVHIEVA

SEQ ID NO: 266 - protein, 9 aa, Artificial Sequence
  Artificial peptide sequence
APLKNAISA

SEQ ID NO: 267 - protein, 9 aa, Artificial Sequence
  Artificial peptide sequence
ASRNNMTKA

SEQ ID NO: 268 - protein, 9 aa, Artificial Sequence
  Artificial peptide sequence
ARKVQAGVA

SEQ ID NO: 269 - protein, 9 aa, Artificial Sequence
  Artificial peptide sequence
AGFTNNTKA

SEQ ID NO: 270 - protein, 9 aa, Artificial Sequence
  Artificial peptide sequence
APRKVTQSA

SEQ ID NO: 271 - protein, 9 aa, Artificial Sequence
  Artificial peptide sequence
APLKKGAVA

SEQ ID NO: 272 - protein, 9 aa, Artificial Sequence
  Artificial peptide sequence
APGKSTAKA

SEQ ID NO: 273 - protein, 9 aa, Artificial Sequence
  Artificial peptide sequence
AGRCILGCA

SEQ ID NO: 274 - protein, 9 aa, Artificial Sequence
  Artificial peptide sequence
ALNINSTKA

SEQ ID NO: 275 - protein, 9 aa, Artificial Sequence
  Artificial peptide sequence
APLGNGAKA

SEQ ID NO: 276 - protein, 9 aa, Artificial Sequence
  Artificial peptide sequence
AGNHPNKVA

SEQ ID NO: 277 - protein, 9 aa, Artificial Sequence
  Artificial peptide sequence
AKNVHPNSA

SEQ ID NO: 278 - protein, 9 aa, Artificial Sequence
  Artificial peptide sequence
APLKAKTSA

SEQ ID NO: 279 - protein, 9 aa, Artificial Sequence
  Artificial peptide sequence
APLQNSVKA

SEQ ID NO: 280 - protein, 9 aa, Artificial Sequence
  Artificial peptide sequence
AKYKQGVSA

SEQ ID NO: 281 - protein, 9 aa, Artificial Sequence
  Artificial peptide sequence
AGSGMILEA

SEQ ID NO: 282 - protein, 9 aa, Artificial Sequence
  Artificial peptide sequence
ARKVHVPVA

SEQ ID NO: 283 - protein, 9 aa, Artificial Sequence
  Artificial peptide sequence
ARKIQTMSA

SEQ ID NO: 284 - protein, 9 aa, Artificial Sequence
  Artificial peptide sequence
ALRGNKIQA

SEQ ID NO: 285 - protein, 9 aa, Artificial Sequence
  Artificial peptide sequence
APIANNTRA

SEQ ID NO: 286 - protein, 9 aa, Artificial Sequence
  Artificial peptide sequence
AFHHPNAVA

SEQ ID NO: 287 - protein, 9 aa, Artificial Sequence
  Artificial peptide sequence
ALKVHIEVA

SEQ ID NO: 288 - protein, 9 aa, Artificial Sequence
  Artificial peptide sequence
APRGVKTTA

SEQ ID NO: 289 - protein, 9 aa, Artificial Sequence
  Artificial peptide sequence
AGSFMSTDA

SEQ ID NO: 290 - protein, 9 aa, Artificial Sequence
  Artificial peptide sequence
AKQIHPNSA

SEQ ID NO: 291 - protein, 9 aa, Artificial Sequence
  Artificial peptide sequence
ARWRNVTKA

SEQ ID NO: 292 - protein, 9 aa, Artificial Sequence
  Artificial peptide sequence
ARKYRGDMA

SEQ ID NO: 293 - protein, 9 aa, Artificial Sequence
  Artificial peptide sequence
APLHNRNNA

SEQ ID NO: 294 - protein, 9 aa, Artificial Sequence
  Artificial peptide sequence
APHSNRTVA

SEQ ID NO: 295 - protein, 9 aa, Artificial Sequence
  Artificial peptide sequence
AGIRNVVKA

SEQ ID NO: 296 - protein, 9 aa, Artificial Sequence
  Artificial peptide sequence
ARSSKPNSA

SEQ ID NO: 297 - protein, 9 aa, Artificial Sequence
  Artificial peptide sequence
ARTKNGVPA

SEQ ID NO: 298 - protein, 9 aa, Artificial Sequence
  Artificial peptide sequence
ARYHANSIA

SEQ ID NO: 299 - protein, 9 aa, Artificial Sequence
  Artificial peptide sequence
AVRTNAVKA

SEQ ID NO: 300 - protein, 9 aa, Artificial Sequence
  Artificial peptide sequence
AIVSNHSKA

SEQ ID NO: 301 - protein, 9 aa, Artificial Sequence
  Artificial peptide sequence
APFDNHIRA

SEQ ID NO: 302 - protein, 9 aa, Artificial Sequence
  Artificial peptide sequence
APRKPNASA

SEQ ID NO: 303 - protein, 9 aa, Artificial Sequence
  Artificial peptide sequence
ARKVHIGGA

SEQ ID NO: 304 - protein, 9 aa, Artificial Sequence
  Artificial peptide sequence
AKRASGPTA

SEQ ID NO: 305 - protein, 9 aa, Artificial Sequence
  Artificial peptide sequence
AECESYFKA

SEQ ID NO: 306 - protein, 9 aa, Artificial Sequence
  Artificial peptide sequence
APPGRKSSA

SEQ ID NO: 307 - protein, 9 aa, Artificial Sequence
  Artificial peptide sequence
ARKYQGDIA

SEQ ID NO: 308 - protein, 9 aa, Artificial Sequence
  Artificial peptide sequence
APITNRSTA

SEQ ID NO: 309 - protein, 9 aa, Artificial Sequence
  Artificial peptide sequence
APRSVGKAA

SEQ ID NO: 310 - protein, 9 aa, Artificial Sequence
  Artificial peptide sequence
ACKMHMPDA

SEQ ID NO: 311 - protein, 9 aa, Artificial Sequence
  Artificial peptide sequence
APLNKKVAA

SEQ ID NO: 312 - protein, 9 aa, Artificial Sequence
  Artificial peptide sequence
APIANKVSA

SEQ ID NO: 313 - protein, 9 aa, Artificial Sequence
  Artificial peptide sequence
APRSGVTKA

SEQ ID NO: 314 - protein, 9 aa, Artificial Sequence
  Artificial peptide sequence
AIRHPNVVA

SEQ ID NO: 315 - protein, 9 aa, Artificial Sequence
  Artificial peptide sequence
APYQNIVKA

SEQ ID NO: 316 - protein, 9 aa, Artificial Sequence
  Artificial peptide sequence
AFTANSTKA

SEQ ID NO: 317 - protein, 9 aa, Artificial Sequence
  Artificial peptide sequence
ARKHQGDMA

SEQ ID NO: 318 - protein, 9 aa, Artificial Sequence
  Artificial peptide sequence
APLRILLKA

SEQ ID NO: 319 - protein, 9 aa, Artificial Sequence
  Artificial peptide sequence
AEGAHIEVA

SEQ ID NO: 320 - protein, 9 aa, Artificial Sequence
  Artificial peptide sequence
AGYSNSVKA

SEQ ID NO: 321 - protein, 9 aa, Artificial Sequence
  Artificial peptide sequence
APLTNRISA

SEQ ID NO: 322 - protein, 9 aa, Artificial Sequence
  Artificial peptide sequence
APPHAKKNA

SEQ ID NO: 323 - protein, 9 aa, Artificial Sequence
  Artificial peptide sequence
AGSFLSTDA

SEQ ID NO: 324 - protein, 9 aa, Artificial Sequence
  Artificial peptide sequence
ARKYQFDLA

SEQ ID NO: 325 - protein, 9 aa, Artificial Sequence
  Artificial peptide sequence
ARLRNTAKA

SEQ ID NO: 326 - protein, 9 aa, Artificial Sequence
  Artificial peptide sequence
ARKMHMLDA

SEQ ID NO: 327 - protein, 9 aa, Artificial Sequence
  Artificial peptide sequence
APVLNSAKA

SEQ ID NO: 328 - protein, 9 aa, Artificial Sequence
  Artificial peptide sequence
AGISRNSVA

SEQ ID NO: 329 - protein, 9 aa, Artificial Sequence
  Artificial peptide sequence
ARSNNTIKA

SEQ ID NO: 330 - protein, 9 aa, Artificial Sequence
  Artificial peptide sequence
AGVLRNSIA

SEQ ID NO: 331 - protein, 9 aa, Artificial Sequence
  Artificial peptide sequence
ALLRNSTKA

SEQ ID NO: 332 - protein, 9 aa, Artificial Sequence
  Artificial peptide sequence
AQIHPNSVA

SEQ ID NO: 333 - protein, 9 aa, Artificial Sequence
  Artificial peptide sequence
AYIHNSTKA

SEQ ID NO: 334 - protein, 9 aa, Artificial Sequence
  Artificial peptide sequence
ALLRILLKA

SEQ ID NO: 335 - protein, 9 aa, Artificial Sequence
  Artificial peptide sequence
APRKNNNSA

SEQ ID NO: 336 - protein, 9 aa, Artificial Sequence
  Artificial peptide sequence
AGIVANAIA

SEQ ID NO: 337 - protein, 9 aa, Artificial Sequence
  Artificial peptide sequence
APRKNTVNA

SEQ ID NO: 338 - protein, 9 aa, Artificial Sequence
  Artificial peptide sequence
ALLRISTKA

SEQ ID NO: 339 - protein, 9 aa, Artificial Sequence
  Artificial peptide sequence
APGSRKAAA

SEQ ID NO: 340 - protein, 9 aa, Artificial Sequence
  Artificial peptide sequence
APKAKGGGA

SEQ ID NO: 341 - protein, 9 aa, Artificial Sequence
  Artificial peptide sequence
APARQKSGA

SEQ ID NO: 342 - protein, 9 aa, Artificial Sequence
  Artificial peptide sequence
AKSKLGVVA

SEQ ID NO: 343 - protein, 9 aa, Artificial Sequence
  Artificial peptide sequence
APRGTGKAA

SEQ ID NO: 344 - protein, 9 aa, Artificial Sequence
  Artificial peptide sequence
APVADVTKA

SEQ ID NO: 345 - protein, 9 aa, Artificial Sequence
  Artificial peptide sequence
AKITNASKA

SEQ ID NO: 346 - protein, 9 aa, Artificial Sequence
  Artificial peptide sequence
APRKQTTSA

SEQ ID NO: 347 - protein, 9 aa, Artificial Sequence
  Artificial peptide sequence
ALLRNANKA

SEQ ID NO: 348 - protein, 9 aa, Artificial Sequence
  Artificial peptide sequence
ARKYPVSLA

SEQ ID NO: 349 - protein, 9 aa, Artificial Sequence
  Artificial peptide sequence
APRGNEVKA

SEQ ID NO: 350 - protein, 9 aa, Artificial Sequence
  Artificial peptide sequence
AWDECVTKA

SEQ ID NO: 351 - protein, 9 aa, Artificial Sequence
  Artificial peptide sequence
ARKWQQFEA

SEQ ID NO: 352 - protein, 9 aa, Artificial Sequence
  Artificial peptide sequence
ASLTNTVKA

SEQ ID NO: 353 - protein, 9 aa, Artificial Sequence
  Artificial peptide sequence
AGLANAVRA

SEQ ID NO: 354 - protein, 9 aa, Artificial Sequence
  Artificial peptide sequence
ARSGNKVNA

SEQ ID NO: 355 - protein, 9 aa, Artificial Sequence
  Artificial peptide sequence
APRNNSSKA

SEQ ID NO: 356 - protein, 9 aa, Artificial Sequence
  Artificial peptide sequence
AFSHPNMIA

SEQ ID NO: 357 - protein, 9 aa, Artificial Sequence
  Artificial peptide sequence
APMTNKVSA

SEQ ID NO: 358 - protein, 9 aa, Artificial Sequence
  Artificial peptide sequence
AGSFQVGSA

SEQ ID NO: 359 - protein, 9 aa, Artificial Sequence
  Artificial peptide sequence
ALYEFYFKA

SEQ ID NO: 360 - protein, 9 aa, Artificial Sequence
  Artificial peptide sequence
APRASGSKA

SEQ ID NO: 361 - protein, 9 aa, Artificial Sequence
  Artificial peptide sequence
AGRFIWMRA

SEQ ID NO: 362 - protein, 9 aa, Artificial Sequence
  Artificial peptide sequence
ALGSNSVRA

SEQ ID NO: 363 - protein, 9 aa, Artificial Sequence
  Artificial peptide sequence
AGSFIVLDA

SEQ ID NO: 364 - protein, 9 aa, Artificial Sequence
  Artificial peptide sequence
APGHKAAKA

SEQ ID NO: 365 - protein, 9 aa, Artificial Sequence
  Artificial peptide sequence
APIKAVKTA

SEQ ID NO: 366 - protein, 9 aa, Artificial Sequence
  Artificial peptide sequence
APMSNRAAA

SEQ ID NO: 367 - protein, 9 aa, Artificial Sequence
  Artificial peptide sequence
APLMNKVVA

SEQ ID NO: 368 - protein, 9 aa, Artificial Sequence
  Artificial peptide sequence
ARYMGNSIA

SEQ ID NO: 369 - protein, 9 aa, Artificial Sequence
  Artificial peptide sequence
APRVAKPLA

SEQ ID NO: 370 - protein, 9 aa, Artificial Sequence
  Artificial peptide sequence
ARLGNASKA

SEQ ID NO: 371 - protein, 9 aa, Artificial Sequence
  Artificial peptide sequence
ARKVRVGVA

SEQ ID NO: 372 - protein, 9 aa, Artificial Sequence
  Artificial peptide sequence
ASMNNSTKA

SEQ ID NO: 373 - protein, 9 aa, Artificial Sequence
  Artificial peptide sequence
ALVRNDTRA

SEQ ID NO: 374 - protein, 9 aa, Artificial Sequence
  Artificial peptide sequence
APAMNITKA

SEQ ID NO: 375 - protein, 9 aa, Artificial Sequence
  Artificial peptide sequence
APLNKKLSA

SEQ ID NO: 376 - protein, 9 aa, Artificial Sequence
  Artificial peptide sequence
APYRQCYEA

SEQ ID NO: 377 - protein, 9 aa, Artificial Sequence
  Artificial peptide sequence
APKLATTKA

SEQ ID NO: 378 - protein, 9 aa, Artificial Sequence
  Artificial peptide sequence
APAWVKVTA

SEQ ID NO: 379 - protein, 9 aa, Artificial Sequence
  Artificial peptide sequence
APLTNAVKA

SEQ ID NO: 380 - protein, 9 aa, Artificial Sequence
  Artificial peptide sequence
AGRLHIGVA

SEQ ID NO: 381 - protein, 9 aa, Artificial Sequence
  Artificial peptide sequence
AGVIMGREA

SEQ ID NO: 382 - protein, 9 aa, Artificial Sequence
  Artificial peptide sequence
APLPNSIKA

SEQ ID NO: 383 - protein, 9 aa, Artificial Sequence
  Artificial peptide sequence
APSGKKTSA

SEQ ID NO: 384 - protein, 9 aa, Artificial Sequence
  Artificial peptide sequence
APRVSGAKA

SEQ ID NO: 385 - protein, 9 aa, Artificial Sequence
  Artificial peptide sequence
ARVDNKVKA

SEQ ID NO: 386 - protein, 9 aa, Artificial Sequence
  Artificial peptide sequence
ARKVHIRVA

SEQ ID NO: 387 - protein, 9 aa, Artificial Sequence
  Artificial peptide sequence
AGSIQGDMA

SEQ ID NO: 388 - protein, 9 aa, Artificial Sequence
  Artificial peptide sequence
AGKFHSTDA

SEQ ID NO: 389 - protein, 9 aa, Artificial Sequence
  Artificial peptide sequence
AGSISRICA

SEQ ID NO: 390 - protein, 9 aa, Artificial Sequence
  Artificial peptide sequence
AGISSNKTA

SEQ ID NO: 391 - protein, 9 aa, Artificial Sequence
  Artificial peptide sequence
APHVNTVRA

SEQ ID NO: 392 - protein, 9 aa, Artificial Sequence
  Artificial peptide sequence
ALRNKAAQA

SEQ ID NO: 393 - protein, 9 aa, Artificial Sequence
  Artificial peptide sequence
APRLNEVKA

SEQ ID NO: 394 - protein, 9 aa, Artificial Sequence
  Artificial peptide sequence
AGVHMNSIA

SEQ ID NO: 395 - protein, 9 aa, Artificial Sequence
  Artificial peptide sequence
APFTDSTKA

SEQ ID NO: 396 - protein, 9 aa, Artificial Sequence
  Artificial peptide sequence
AARYHGSEA

SEQ ID NO: 397 - protein, 9 aa, Artificial Sequence
  Artificial peptide sequence
APAGNEVKA

SEQ ID NO: 398 - protein, 9 aa, Artificial Sequence
  Artificial peptide sequence
AKVHIIEVA

SEQ ID NO: 399 - protein, 9 aa, Artificial Sequence
  Artificial peptide sequence
AGRCMAEVA

SEQ ID NO: 400 - protein, 9 aa, Artificial Sequence
  Artificial peptide sequence
APLAKSSKA

SEQ ID NO: 401 - protein, 9 aa, Artificial Sequence
  Artificial peptide sequence
APVSNTTRA

SEQ ID NO: 402 - protein, 9 aa, Artificial Sequence
  Artificial peptide sequence
AGVVTNHVA

SEQ ID NO: 403 - protein, 9 aa, Artificial Sequence
  Artificial peptide sequence
AWDEDVTKA

SEQ ID NO: 404 - protein, 9 aa, Artificial Sequence
  Artificial peptide sequence
ALTANTVKA

SEQ ID NO: 405 - protein, 9 aa, Artificial Sequence
  Artificial peptide sequence
ALLRDTVKA

SEQ ID NO: 406 - protein, 9 aa, Artificial Sequence
  Artificial peptide sequence
AQRYHGSEA

SEQ ID NO: 407 - protein, 9 aa, Artificial Sequence
  Artificial peptide sequence
ARVRRGAVA

SEQ ID NO: 408 - protein, 9 aa, Artificial Sequence
  Artificial peptide sequence
APLVKTTKA

SEQ ID NO: 409 - protein, 9 aa, Artificial Sequence
  Artificial peptide sequence
AAKYHGPPA

SEQ ID NO: 410 - protein, 9 aa, Artificial Sequence
  Artificial peptide sequence
AGIRNNSTA

SEQ ID NO: 411 - protein, 9 aa, Artificial Sequence
  Artificial peptide sequence
AKTGGKVAA

SEQ ID NO: 412 - protein, 9 aa, Artificial Sequence
  Artificial peptide sequence
ARFPAGSLA

SEQ ID NO: 413 - protein, 9 aa, Artificial Sequence
  Artificial peptide sequence
APGGKANKA

SEQ ID NO: 414 - protein, 9 aa, Artificial Sequence
  Artificial peptide sequence
AYTKKSVAA

SEQ ID NO: 415 - protein, 9 aa, Artificial Sequence
  Artificial peptide sequence
APGTNVIKA

SEQ ID NO: 416 - protein, 9 aa, Artificial Sequence
  Artificial peptide sequence
AGSGMILRA

SEQ ID NO: 417 - protein, 9 aa, Artificial Sequence
  Artificial peptide sequence
APKGTTAKA

SEQ ID NO: 418 - protein, 9 aa, Artificial Sequence
  Artificial peptide sequence
ARKIHFGCA

SEQ ID NO: 419 - protein, 9 aa, Artificial Sequence
  Artificial peptide sequence
ALTTNSIRA

SEQ ID NO: 420 - protein, 9 aa, Artificial Sequence
  Artificial peptide sequence
ARWQIFTKA

SEQ ID NO: 421 - protein, 9 aa, Artificial Sequence
  Artificial peptide sequence
AGSVNSVKA

SEQ ID NO: 422 - protein, 9 aa, Artificial Sequence
  Artificial peptide sequence
APSATKNKA

SEQ ID NO: 423 - protein, 9 aa, Artificial Sequence
  Artificial peptide sequence
ARKVHIECA

SEQ ID NO: 424 - protein, 9 aa, Artificial Sequence
  Artificial peptide sequence
AAAGNQVKA

SEQ ID NO: 425 - protein, 9 aa, Artificial Sequence
  Artificial peptide sequence
AMVSNATKA

SEQ ID NO: 426 - protein, 9 aa, Artificial Sequence
  Artificial peptide sequence
AGIVTNHVA

SEQ ID NO: 427 - protein, 9 aa, Artificial Sequence
  Artificial peptide sequence
ALSLNATKA

SEQ ID NO: 428 - protein, 9 aa, Artificial Sequence
  Artificial peptide sequence
APLANTVKA

SEQ ID NO: 429 - protein, 9 aa, Artificial Sequence
  Artificial peptide sequence
APYRNATKA

SEQ ID NO: 430 - protein, 9 aa, Artificial Sequence
  Artificial peptide sequence
AGRCILKVA

SEQ ID NO: 431 - protein, 9 aa, Artificial Sequence
  Artificial peptide sequence
AWSRSPNAA

SEQ ID NO: 432 - protein, 9 aa, Artificial Sequence
  Artificial peptide sequence
AMASNSVRA

SEQ ID NO: 433 - protein, 9 aa, Artificial Sequence
  Artificial peptide sequence
AMAQNSVKA

SEQ ID NO: 434 - protein, 9 aa, Artificial Sequence
  Artificial peptide sequence
AGIQNNHIA

SEQ ID NO: 435 - protein, 9 aa, Artificial Sequence
  Artificial peptide sequence
APLKLKAAA

SEQ ID NO: 436 - protein, 9 aa, Artificial Sequence
  Artificial peptide sequence
APYHIATKA

SEQ ID NO: 437 - protein, 9 aa, Artificial Sequence
  Artificial peptide sequence
ARWRMLLKA

SEQ ID NO: 438 - protein, 9 aa, Artificial Sequence
  Artificial peptide sequence
APKKSGSPA

SEQ ID NO: 439 - protein, 9 aa, Artificial Sequence
  Artificial peptide sequence
ARMSNKTSA

SEQ ID NO: 440 - protein, 9 aa, Artificial Sequence
  Artificial peptide sequence
AGRLTNQIA

SEQ ID NO: 441 - protein, 9 aa, Artificial Sequence
  Artificial peptide sequence
APRAGKAAA

SEQ ID NO: 442 - protein, 9 aa, Artificial Sequence
  Artificial peptide sequence
AGTKNMIKA

SEQ ID NO: 443 - protein, 9 aa, Artificial Sequence
  Artificial peptide sequence
ARKIHLDTA

SEQ ID NO: 444 - protein, 9 aa, Artificial Sequence
  Artificial peptide sequence
ARMSNESRA

SEQ ID NO: 445 - protein, 9 aa, Artificial Sequence
  Artificial peptide sequence
AVVSNAAQA

SEQ ID NO: 446 - protein, 9 aa, Artificial Sequence
  Artificial peptide sequence
APRTVGNKA

SEQ ID NO: 447 - protein, 9 aa, Artificial Sequence
  Artificial peptide sequence
APSVDLTKA

SEQ ID NO: 448 - protein, 9 aa, Artificial Sequence
  Artificial peptide sequence
APRKNSAAA

SEQ ID NO: 449 - protein, 9 aa, Artificial Sequence
  Artificial peptide sequence
APIGNTTRA

SEQ ID NO: 450 - protein, 9 aa, Artificial Sequence
  Artificial peptide sequence
AKYIPGTLA

SEQ ID NO: 451 - protein, 9 aa, Artificial Sequence
  Artificial peptide sequence
APRKPGVQA

SEQ ID NO: 452 - protein, 9 aa, Artificial Sequence
  Artificial peptide sequence
APRKTSATA

SEQ ID NO: 453 - protein, 9 aa, Artificial Sequence
  Artificial peptide sequence
APFADSTKA

SEQ ID NO: 454 - protein, 9 aa, Artificial Sequence
  Artificial peptide sequence
APHTKSKSA

SEQ ID NO: 455 - protein, 9 aa, Artificial Sequence
  Artificial peptide sequence
ARKFRSTDA

SEQ ID NO: 456 - protein, 9 aa, Artificial Sequence
  Artificial peptide sequence
AGSIRSDLA

SEQ ID NO: 457 - protein, 9 aa, Artificial Sequence
  Artificial peptide sequence
ASYEDTVKA

SEQ ID NO: 458 - protein, 9 aa, Artificial Sequence
  Artificial peptide sequence
ALLRIRLRA

SEQ ID NO: 459 - protein, 9 aa, Artificial Sequence
  Artificial peptide sequence
ARRCILRVA

SEQ ID NO: 460 - protein, 9 aa, Artificial Sequence
  Artificial peptide sequence
AGTLNAIKA

SEQ ID NO: 461 - protein, 9 aa, Artificial Sequence
  Artificial peptide sequence
AQRHNDTRA

SEQ ID NO: 462 - protein, 9 aa, Artificial Sequence
  Artificial peptide sequence
ARKLQSAQA

SEQ ID NO: 463 - protein, 9 aa, Artificial Sequence
  Artificial peptide sequence
AKVKGTSAA

SEQ ID NO: 464 - protein, 9 aa, Artificial Sequence
  Artificial peptide sequence
APRSVQKSA

SEQ ID NO: 465 - protein, 9 aa, Artificial Sequence
  Artificial peptide sequence
APRGNNLKA

SEQ ID NO: 466 - protein, 9 aa, Artificial Sequence
  Artificial peptide sequence
APYHNVTKA

SEQ ID NO: 467 - protein, 9 aa, Artificial Sequence
  Artificial peptide sequence
AGRCMARVA

SEQ ID NO: 468 - protein, 9 aa, Artificial Sequence
  Artificial peptide sequence
ARKWYDTEA

SEQ ID NO: 469 - protein, 9 aa, Artificial Sequence
  Artificial peptide sequence
ARKFHSIDA

SEQ ID NO: 470 - protein, 9 aa, Artificial Sequence
  Artificial peptide sequence
AKKIDNRVA

SEQ ID NO: 471 - protein, 9 aa, Artificial Sequence
  Artificial peptide sequence
AGAHPNSLA

SEQ ID NO: 472 - protein, 9 aa, Artificial Sequence
  Artificial peptide sequence
APMGRKAAA

SEQ ID NO: 473 - protein, 9 aa, Artificial Sequence
  Artificial peptide sequence
AGKWHDTEA

SEQ ID NO: 474 - protein, 9 aa, Artificial Sequence
  Artificial peptide sequence
APFYEFTKA

SEQ ID NO: 475 - protein, 9 aa, Artificial Sequence
  Artificial peptide sequence
APNRKSATA

SEQ ID NO: 476 - protein, 9 aa, Artificial Sequence
  Artificial peptide sequence
APSGNSSRA

SEQ ID NO: 477 - protein, 9 aa, Artificial Sequence
  Artificial peptide sequence
AAQGNTVRA

SEQ ID NO: 478 - protein, 9 aa, Artificial Sequence
  Artificial peptide sequence
APRTKSIVA

SEQ ID NO: 479 - protein, 9 aa, Artificial Sequence
  Artificial peptide sequence
APHLNLAKA

SEQ ID NO: 480 - protein, 9 aa, Artificial Sequence
  Artificial peptide sequence
APRGAKSSA

SEQ ID NO: 481 - protein, 9 aa, Artificial Sequence
  Artificial peptide sequence
APKITKPSA

SEQ ID NO: 482 - protein, 9 aa, Artificial Sequence
  Artificial peptide sequence
ARKYRSDLA

SEQ ID NO: 483 - protein, 9 aa, Artificial Sequence
  Artificial peptide sequence
ARKYQSSLA

SEQ ID NO: 484 - protein, 9 aa, Artificial Sequence
  Artificial peptide sequence
ARKWRQSEA

SEQ ID NO: 485 - protein, 9 aa, Artificial Sequence
  Artificial peptide sequence
AVKMHMPDA

SEQ ID NO: 486 - protein, 9 aa, Artificial Sequence
  Artificial peptide sequence
AKVGGKAAA

SEQ ID NO: 487 - protein, 9 aa, Artificial Sequence
  Artificial peptide sequence
APRQVSKTA

SEQ ID NO: 488 - protein, 9 aa, Artificial Sequence
  Artificial peptide sequence
APATTKVKA

SEQ ID NO: 489 - protein, 9 aa, Artificial Sequence
  Artificial peptide sequence
ARKIHDGPA

SEQ ID NO: 490 - protein, 9 aa, Artificial Sequence
  Artificial peptide sequence
AGILRNTIA

SEQ ID NO: 491 - protein, 9 aa, Artificial Sequence
  Artificial peptide sequence
APSSGKKVA

SEQ ID NO: 492 - protein, 9 aa, Artificial Sequence
  Artificial peptide sequence
APRSAKPAA

SEQ ID NO: 493 - protein, 9 aa, Artificial Sequence
  Artificial peptide sequence
ARWRIFTKA

SEQ ID NO: 494 - protein, 9 aa, Artificial Sequence
  Artificial peptide sequence
AKVNNLTKA

SEQ ID NO: 495 - protein, 9 aa, Artificial Sequence
  Artificial peptide sequence
APNSNIIKA

SEQ ID NO: 496 - protein, 9 aa, Artificial Sequence
  Artificial peptide sequence
ARKWHDAEA

SEQ ID NO: 497 - protein, 9 aa, Artificial Sequence
  Artificial peptide sequence
AGSFHTETA

SEQ ID NO: 498 - protein, 9 aa, Artificial Sequence
  Artificial peptide sequence
ARKYPVGFA

SEQ ID NO: 499 - protein, 9 aa, Artificial Sequence
  Artificial peptide sequence
ALRGVKVTA

SEQ ID NO: 500 - protein, 9 aa, Artificial Sequence
  Artificial peptide sequence
APLGKKISA

SEQ ID NO: 501 - protein, 9 aa, Artificial Sequence
  Artificial peptide sequence
ARATNEVRA

SEQ ID NO: 502 - protein, 9 aa, Artificial Sequence
  Artificial peptide sequence
APGGNEVRA

SEQ ID NO: 503 - protein, 9 aa, Artificial Sequence
  Artificial peptide sequence
ALLGNAVKA

SEQ ID NO: 504 - protein, 9 aa, Artificial Sequence
  Artificial peptide sequence
APHSNRVSA

SEQ ID NO: 505 - protein, 9 aa, Artificial Sequence
  Artificial peptide sequence
APRSKNAVA

SEQ ID NO: 506 - protein, 9 aa, Artificial Sequence
  Artificial peptide sequence
APSINKVKA

SEQ ID NO: 507 - protein, 9 aa, Artificial Sequence
  Artificial peptide sequence
APAANTVRA

SEQ ID NO: 508 - protein, 9 aa, Artificial Sequence
  Artificial peptide sequence
ALCRNSAKA

SEQ ID NO: 509 - protein, 9 aa, Artificial Sequence
  Artificial peptide sequence
APLRSAVKA

SEQ ID NO: 510 - protein, 9 aa, Artificial Sequence
  Artificial peptide sequence
APLKKHAAA

SEQ ID NO: 511 - protein, 9 aa, Artificial Sequence
  Artificial peptide sequence
APLTNTVGA

SEQ ID NO: 512 - protein, 9 aa, Artificial Sequence
  Artificial peptide sequence
ALLIILVKA

SEQ ID NO: 513 - protein, 9 aa, Artificial Sequence
  Artificial peptide sequence
ALMSNRATA

SEQ ID NO: 514 - protein, 9 aa, Artificial Sequence
  Artificial peptide sequence
APLVNAVKA

SEQ ID NO: 515 - protein, 9 aa, Artificial Sequence
  Artificial peptide sequence
APSSKKATA

SEQ ID NO: 516 - protein, 9 aa, Artificial Sequence
  Artificial peptide sequence
AKFIIGSLA

SEQ ID NO: 517 - protein, 9 aa, Artificial Sequence
  Artificial peptide sequence
APSTNRVTA

SEQ ID NO: 518 - protein, 9 aa, Artificial Sequence
  Artificial peptide sequence
APKAPNKSA

SEQ ID NO: 519 - protein, 9 aa, Artificial Sequence
  Artificial peptide sequence
AKVKLGAAA

SEQ ID NO: 520 - protein, 9 aa, Artificial Sequence
  Artificial peptide sequence
AEVSVPDLA

SEQ ID NO: 521 - protein, 9 aa, Artificial Sequence
  Artificial peptide sequence
AGSFIGTDA

SEQ ID NO: 522 - protein, 9 aa, Artificial Sequence
  Artificial peptide sequence
AEVSYSTDA

SEQ ID NO: 523 - protein, 9 aa, Artificial Sequence
  Artificial peptide sequence
AGRCIAEVA

SEQ ID NO: 524 - protein, 9 aa, Artificial Sequence
  Artificial peptide sequence
ARKYQSDFA

SEQ ID NO: 525 - protein, 9 aa, Artificial Sequence
  Artificial peptide sequence
AALGNVVRA

SEQ ID NO: 526 - protein, 9 aa, Artificial Sequence
  Artificial peptide sequence
AVASNVVKA

SEQ ID NO: 527 - protein, 9 aa, Artificial Sequence
  Artificial peptide sequence
ALAGNAVKA

SEQ ID NO: 528 - protein, 9 aa, Artificial Sequence
  Artificial peptide sequence
APASNVARA

SEQ ID NO: 529 - protein, 9 aa, Artificial Sequence
  Artificial peptide sequence
AYGHPIVIA

SEQ ID NO: 530 - protein, 9 aa, Artificial Sequence
  Artificial peptide sequence
ALWLNLVKA

SEQ ID NO: 531 - protein, 9 aa, Artificial Sequence
  Artificial peptide sequence
ALSVNLTKA

SEQ ID NO: 532 - protein, 9 aa, Artificial Sequence
  Artificial peptide sequence
APLRNSTKA

SEQ ID NO: 533 - protein, 9 aa, Artificial Sequence
  Artificial peptide sequence
ALYHPNKVA

SEQ ID NO: 534 - protein, 9 aa, Artificial Sequence
  Artificial peptide sequence
ARRYQSDLA

SEQ ID NO: 535 - protein, 9 aa, Artificial Sequence
  Artificial peptide sequence
AAKAMKLGA

SEQ ID NO: 536 - protein, 9 aa, Artificial Sequence
  Artificial peptide sequence
AAMGNASRA

SEQ ID NO: 537 - protein, 9 aa, Artificial Sequence
  Artificial peptide sequence
APRALKITA

SEQ ID NO: 538 - protein, 9 aa, Artificial Sequence
  Artificial peptide sequence
ALSLNLVKA

SEQ ID NO: 539 - protein, 9 aa, Artificial Sequence
  Artificial peptide sequence
ALVANVTKA

SEQ ID NO: 540 - protein, 9 aa, Artificial Sequence
  Artificial peptide sequence
AKFVPGTLA

SEQ ID NO: 541 - protein, 9 aa, Artificial Sequence
  Artificial peptide sequence
ASIHPNAIA

SEQ ID NO: 542 - protein, 9 aa, Artificial Sequence
  Artificial peptide sequence
AKMKVGVSA

SEQ ID NO: 543 - protein, 9 aa, Artificial Sequence
  Artificial peptide sequence
APVGAKKGA

SEQ ID NO: 544 - protein, 9 aa, Artificial Sequence
  Artificial peptide sequence
ASYEYTVKA

SEQ ID NO: 545 - protein, 9 aa, Artificial Sequence
  Artificial peptide sequence
AQEVSVDLA

SEQ ID NO: 546 - protein, 9 aa, Artificial Sequence
  Artificial peptide sequence
AGVIMESEA

SEQ ID NO: 547 - protein, 9 aa, Artificial Sequence
  Artificial peptide sequence
AEGACIEVA

SEQ ID NO: 548 - protein, 9 aa, Artificial Sequence
  Artificial peptide sequence
AVLFRNIPA

SEQ ID NO: 549 - protein, 9 aa, Artificial Sequence
  Artificial peptide sequence
APKRSNATA

SEQ ID NO: 550 - protein, 9 aa, Artificial Sequence
  Artificial peptide sequence
ALRQNLVKA

SEQ ID NO: 551 - protein, 9 aa, Artificial Sequence
  Artificial peptide sequence
ALRINNVKA

SEQ ID NO: 552 - protein, 9 aa, Artificial Sequence
  Artificial peptide sequence
APRKAGTVA

SEQ ID NO: 553 - protein, 9 aa, Artificial Sequence
  Artificial peptide sequence
AQRLNNTKA

SEQ ID NO: 554 - protein, 9 aa, Artificial Sequence
  Artificial peptide sequence
APLADLTKA

SEQ ID NO: 555 - protein, 9 aa, Artificial Sequence
  Artificial peptide sequence
APLADTVKA

SEQ ID NO: 556 - protein, 9 aa, Artificial Sequence
  Artificial peptide sequence
AGRCAIEVA

SEQ ID NO: 557 - protein, 9 aa, Artificial Sequence
  Artificial peptide sequence
ARKYQPDLA

SEQ ID NO: 558 - protein, 9 aa, Artificial Sequence
  Artificial peptide sequence
ARKIRLDAA

SEQ ID NO: 559 - protein, 9 aa, Artificial Sequence
  Artificial peptide sequence
ARRCILSAA

SEQ ID NO: 560 - protein, 9 aa, Artificial Sequence
  Artificial peptide sequence
AEVSSPDLA

SEQ ID NO: 561 - protein, 9 aa, Artificial Sequence
  Artificial peptide sequence
AGVIMGSEA

SEQ ID NO: 562 - protein, 9 aa, Artificial Sequence
  Artificial peptide sequence
AVKYQSDLA

SEQ ID NO: 563 - protein, 9 aa, Artificial Sequence
  Artificial peptide sequence
APRQAKVAA

SEQ ID NO: 564 - protein, 9 aa, Artificial Sequence
  Artificial peptide sequence
AQMTNQVKA

SEQ ID NO: 565 - protein, 9 aa, Artificial Sequence
  Artificial peptide sequence
AGQSNQTRA

SEQ ID NO: 566 - protein, 9 aa, Artificial Sequence
  Artificial peptide sequence
APVRAATKA

SEQ ID NO: 567 - protein, 9 aa, Artificial Sequence
  Artificial peptide sequence
AKTKSANSA

SEQ ID NO: 568 - protein, 9 aa, Artificial Sequence
  Artificial peptide sequence
AFSAHPNKA

SEQ ID NO: 569 - protein, 9 aa, Artificial Sequence
  Artificial peptide sequence
ARIKGGVPA

SEQ ID NO: 570 - protein, 9 aa, Artificial Sequence
  Artificial peptide sequence
APWFRDNAA

SEQ ID NO: 571 - protein, 9 aa, Artificial Sequence
  Artificial peptide sequence
APSKGKSNA

SEQ ID NO: 572 - protein, 9 aa, Artificial Sequence
  Artificial peptide sequence
APRTNNTVA

SEQ ID NO: 573 - protein, 9 aa, Artificial Sequence
  Artificial peptide sequence
APKTSKSSA

SEQ ID NO: 574 - protein, 9 aa, Artificial Sequence
  Artificial peptide sequence
ARKYQAASA

SEQ ID NO: 575 - protein, 9 aa, Artificial Sequence
  Artificial peptide sequence
APKANLAKA

SEQ ID NO: 576 - protein, 9 aa, Artificial Sequence
  Artificial peptide sequence
AGVIMGPEA

SEQ ID NO: 577 - protein, 9 aa, Artificial Sequence
  Artificial peptide sequence
ASYGIRLKA

SEQ ID NO: 578 - protein, 9 aa, Artificial Sequence
  Artificial peptide sequence
APRTGATKA

SEQ ID NO: 579 - protein, 9 aa, Artificial Sequence
  Artificial peptide sequence
AARGVKVTA

SEQ ID NO: 580 - protein, 9 aa, Artificial Sequence
  Artificial peptide sequence
AGSIRSDMA

SEQ ID NO: 581 - protein, 9 aa, Artificial Sequence
  Artificial peptide sequence
ARIVILVKA

SEQ ID NO: 582 - protein, 9 aa, Artificial Sequence
  Artificial peptide sequence
ALLRIPTKA

SEQ ID NO: 583 - protein, 9 aa, Artificial Sequence
  Artificial peptide sequence
AAWGVKVTA

SEQ ID NO: 584 - protein, 9 aa, Artificial Sequence
  Artificial peptide sequence
APTKKTAVA

SEQ ID NO: 585 - protein, 9 aa, Artificial Sequence
  Artificial peptide sequence
AIMLNQVKA

SEQ ID NO: 586 - protein, 9 aa, Artificial Sequence
  Artificial peptide sequence
APGLNYVKA

SEQ ID NO: 587 - protein, 9 aa, Artificial Sequence
  Artificial peptide sequence
ARKLHSGPA

SEQ ID NO: 588 - protein, 9 aa, Artificial Sequence
  Artificial peptide sequence
AKWKSGASA

SEQ ID NO: 589 - protein, 9 aa, Artificial Sequence
  Artificial peptide sequence
AWKAQKTSA

SEQ ID NO: 590 - protein, 9 aa, Artificial Sequence
  Artificial peptide sequence
APRTKGTAA

SEQ ID NO: 591 - protein, 9 aa, Artificial Sequence
  Artificial peptide sequence
APRHSKVTA

SEQ ID NO: 592 - protein, 9 aa, Artificial Sequence
  Artificial peptide sequence
AGTANVTKA

SEQ ID NO: 593 - protein, 9 aa, Artificial Sequence
  Artificial peptide sequence
ALLGNMTKA

SEQ ID NO: 594 - protein, 9 aa, Artificial Sequence
  Artificial peptide sequence
ARKVHIEIA

SEQ ID NO: 595 - protein, 9 aa, Artificial Sequence
  Artificial peptide sequence
AEVSCGPPA

SEQ ID NO: 596 - protein, 9 aa, Artificial Sequence
  Artificial peptide sequence
AKAKAGVTA

SEQ ID NO: 597 - protein, 9 aa, Artificial Sequence
  Artificial peptide sequence
ALILNATKA

SEQ ID NO: 598 - protein, 9 aa, Artificial Sequence
  Artificial peptide sequence
ARSVNLTKA

SEQ ID NO: 599 - protein, 9 aa, Artificial Sequence
  Artificial peptide sequence
ASYEYGAKA

SEQ ID NO: 600 - protein, 9 aa, Artificial Sequence
  Artificial peptide sequence
ALKYRGPPA

SEQ ID NO: 601 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 602 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 603 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 604 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALKYHGPPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 605 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQGDMASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 606 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKFHSTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 607 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKHHGLEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 608 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGTNVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 609 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKMHMPDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 610 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLKKIVQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 611 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLGKKTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 612 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRGVKVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 613 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLAKSKSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 614 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTKGAVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 615 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSGRKATASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 616 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKIHLDAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 617 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPYHNATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 618 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKWHDTEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 619 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPVANVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 620 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIGVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 621 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLNNSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 622 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARRYHGSEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 623 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAYGHPNVIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 624 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPFTNSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 625 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVQVGVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 626 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILRVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 627 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKIKTGVPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 628 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAWHNSYPHASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 629 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSVNLTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 630 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLSNLVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 631 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKFHTETASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 632 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRFILDAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 633 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVKQNQTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 634 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVRSNKVAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 635 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILRWASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 636 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKWQQSEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 637 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLKNGTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 638 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGLKNAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 639 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPAINHVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 640 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVLSNRIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 641 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLANTAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 642 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARRWHGDEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 643 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLRNANKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 644 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNLIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 645 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKLQVGSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 646 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAEGAYIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 647 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPMANLVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 648 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKTVNATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 649 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPVTKKASASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 650 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPMPNSAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 651 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSIQSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 652 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRNTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 653 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGHLSNHIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 654 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPMSNRATASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 655 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQLDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 656 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPHSNSSKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 657 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGLGNAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 658 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSIRGDMASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 659 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRIRLKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 660 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVYIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 661 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAWKVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 662 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRSAKPVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 663 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLANLTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 664 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRGSAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 665 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRLHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 666 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLRISTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 667 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKWQSHEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 668 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 669 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARRCILRWASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 670 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKTKSGINASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 671 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSINSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 672 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSLNLVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 673 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLGNMTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 674 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALYHNATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 675 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLSNLVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 676 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALRHKSNNASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 677 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKSNASASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 678 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPFSNSSKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 679 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILGVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 680 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPASNSSRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 681 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGKYQSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 682 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 683 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALTQNSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 684 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALIANATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 685 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKFHAMEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 686 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLRSTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 687 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARYSPNSVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 688 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGKVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 689 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSISPDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 690 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIEAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 691 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALRMNSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 692 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPAHKVKAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 693 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQACKHHGLEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 694 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGLSNATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 695 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLANRTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 696 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILRCASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 697 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAQEDSFDAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 698 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVSIMGLEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 699 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGTNLIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 700 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQATSGNSVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 701 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARFPVGSLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 702 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRVTKAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 703 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSFHSTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 704 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAHKALVHGASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 705 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLTNTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 706 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLKKIVQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 707 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRDNRTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 708 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRVNKTVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 709 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGIMSNKIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 710 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALFTNTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 711 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTNITKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 712 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSFASTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 713 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPQSNVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 714 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAWRYHGSEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 715 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPHKATKSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 716 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNTAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 717 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLGNTAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 718 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLDNRLKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 719 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILSAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 720 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLINVVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 721 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILKLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 722 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPISGKNKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 723 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKSKAGQVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 724 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGKIHLDAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 725 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGHTNSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 726 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALFTNSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 727 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSTNTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 728 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKIHLMRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 729 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPAPNSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 730 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGITGNKIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 731 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 732 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIEGASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 733 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKKLNNSIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 734 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSISRILASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 735 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGYMGNHIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 736 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVSIMGWEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 737 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVVSNAARASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 738 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRAKVVQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 739 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLGNTVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 740 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTTTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 741 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGTDVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 742 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALGRNVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 743 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALKHHGPPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 744 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLRIPTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 745 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAQATNTVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 746 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASTGNSTRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 747 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPMHNGIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 748 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHTEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 749 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAMKYHGPAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 750 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALHLNSIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 751 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSINTIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 752 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILSVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 753 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKAKAGVAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 754 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSSNAAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 755 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVQSGVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 756 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGKYQGDMASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 757 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAMVIPNVIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 758 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVKHNSIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 759 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKHQSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 760 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKQPNAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 761 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAFTHPNSVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 762 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTSTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 763 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARVGVKVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 764 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAEGVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 765 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASKVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 766 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLKNAISASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 767 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASRNNMTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 768 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVQAGVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 769 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGFTNNTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 770 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKVTQSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 771 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLKKGAVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 772 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGKSTAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 773 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILGCASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 774 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALNINSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 775 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLGNGAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 776 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGNHPNKVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 777 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKNVHPNSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 778 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLKAKTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 779 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLQNSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 780 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKYKQGVSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 781 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSGMILEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 782 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHVPVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 783 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKIQTMSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 784 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALRGNKIQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 785 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPIANNTRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 786 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAFHHPNAVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 787 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALKVHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 788 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRGVKTTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 789 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSFMSTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 790 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKQIHPNSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 791 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARWRNVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 792 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYRGDMASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 793 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLHNRNNASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 794 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPHSNRTVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 795 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGIRNVVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 796 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARSSKPNSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 797 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARTKNGVPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 798 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARYHANSIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 799 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVRTNAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 800 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAIVSNHSKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 801 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPFDNHIRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 802 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKPNASASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 803 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIGGASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 804 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKRASGPTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 805 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAECESYFKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 806 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPPGRKSSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 807 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQGDIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 808 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPITNRSTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 809 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRSVGKAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 810 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQACKMHMPDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 811 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLNKKVAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 812 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPIANKVSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 813 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRSGVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 814 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAIRHPNVVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 815 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPYQNIVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 816 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAFTANSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 817 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKHQGDMASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 818 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLRILLKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 819 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAEGAHIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 820 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGYSNSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 821 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNRISASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 822 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPPHAKKNASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 823 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSFLSTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 824 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQFDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 825 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARLRNTAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 826 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKMHMLDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 827 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPVLNSAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 828 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGISRNSVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 829 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARSNNTIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 830 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVLRNSIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 831 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRNSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 832 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAQIHPNSVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 833 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAYIHNSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 834 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRILLKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 835 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKNNNSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 836 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGIVANAIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 837 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKNTVNASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 838 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRISTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 839 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGSRKAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 840 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKAKGGGASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 841 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPARQKSGASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 842 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKSKLGVVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 843 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRGTGKAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 844 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPVADVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 845 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKITNASKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 846 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKQTTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 847 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRNANKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 848 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYPVSLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 849 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRGNEVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 850 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAWDECVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 851 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKWQQFEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 852 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASLTNTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 853 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGLANAVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 854 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARSGNKVNASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 855 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRNNSSKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 856 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAFSHPNMIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 857 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPMTNKVSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 858 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSFQVGSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 859 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALYEFYFKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 860 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRASGSKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 861 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRFIWMRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 862 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALGSNSVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 863 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSFIVLDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 864 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGHKAAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 865 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPIKAVKTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 866 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPMSNRAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 867 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLMNKVVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 868 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARYMGNSIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 869 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRVAKPLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 870 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARLGNASKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 871 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVRVGVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 872 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASMNNSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 873 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALVRNDTRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 874 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPAMNITKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 875 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLNKKLSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 876 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPYRQCYEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 877 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKLATTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 878 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPAWVKVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 879 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 880 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRLHIGVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 881 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVIMGREASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 882 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLPNSIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 883 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSGKKTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 884 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRVSGAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 885 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARVDNKVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 886 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIRVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 887 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSIQGDMASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 888 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGKFHSTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 889 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSISRICASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 890 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGISSNKTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 891 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPHVNTVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 892 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALRNKAAQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 893 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRLNEVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 894 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVHMNSIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 895 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPFTDSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 896 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAARYHGSEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 897 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPAGNEVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 898 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKVHIIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 899 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCMAEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 900 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLAKSSKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 901 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPVSNTTRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 902 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVVTNHVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 903 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAWDEDVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 904 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALTANTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 905 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRDTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 906 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAQRYHGSEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 907 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARVRRGAVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 908 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLVKTTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 909 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAAKYHGPPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 910 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGIRNNSTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 911 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKTGGKVAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 912 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARFPAGSLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 913 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGGKANKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 914 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAYTKKSVAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 915 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGTNVIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 916 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSGMILRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 917 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKGTTAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 918 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKIHFGCASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 919 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALTTNSIRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 920 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARWQIFTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 921 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSVNSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 922 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSATKNKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 923 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIECASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 924 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAAAGNQVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 925 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAMVSNATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 926 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGIVTNHVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 927 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALSLNATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 928 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLANTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 929 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPYRNATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 930 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCILKVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 931 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAWSRSPNAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 932 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAMASNSVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 933 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAMAQNSVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 934 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGIQNNHIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 935 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLKLKAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 936 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPYHIATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 937 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARWRMLLKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 938 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKKSGSPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 939 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARMSNKTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 940 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRLTNQIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 941 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRAGKAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 942 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGTKNMIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 943 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKIHLDTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 944 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARMSNESRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 945 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVVSNAAQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 946 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTVGNKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 947 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSVDLTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 948 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKNSAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 949 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPIGNTTRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 950 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKYIPGTLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 951 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKPGVQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 952 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKTSATASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 953 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPFADSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 954 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPHTKSKSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 955 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKFRSTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 956 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSIRSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 957 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASYEDTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 958 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRIRLRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 959 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARRCILRVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 960 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGTLNAIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 961 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAQRHNDTRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 962 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKLQSAQASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 963 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKVKGTSAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 964 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRSVQKSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 965 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRGNNLKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 966 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPYHNVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 967 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCMARVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 968 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKWYDTEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 969 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKFHSIDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 970 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKKIDNRVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 971 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGAHPNSLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 972 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPMGRKAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 973 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGKWHDTEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 974 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPFYEFTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 975 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPNRKSATASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 976 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSGNSSRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 977 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAAQGNTVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 978 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTKSIVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 979 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPHLNLAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 980 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRGAKSSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 981 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKITKPSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 982 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYRSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 983 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQSSLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 984 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKWRQSEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 985 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVKMHMPDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 986 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKVGGKAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 987 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRQVSKTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 988 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPATTKVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 989 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKIHDGPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 990 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGILRNTIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 991 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSSGKKVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 992 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRSAKPAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 993 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARWRIFTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 994 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKVNNLTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 995 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPNSNIIKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 996 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKWHDAEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 997 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSFHTETASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 998 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYPVGFASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 999 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALRGVKVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1000 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLGKKISASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1001 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARATNEVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1002 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGGNEVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1003 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLGNAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1004 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPHSNRVSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1005 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRSKNAVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1006 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSINKVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1007 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPAANTVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1008 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALCRNSAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1009 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLRSAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1010 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLKKHAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1011 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLTNTVGASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1012 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLIILVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1013 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALMSNRATASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1014 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLVNAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1015 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSSKKATASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1016 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKFIIGSLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1017 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSTNRVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1018 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKAPNKSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1019 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKVKLGAAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1020 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAEVSVPDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1021 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSFIGTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1022 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAEVSYSTDASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1023 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCIAEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1024 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQSDFASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1025 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAALGNVVRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1026 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVASNVVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1027 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALAGNAVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1028 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPASNVARASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1029 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAYGHPIVIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1030 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALWLNLVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1031 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALSVNLTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1032 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLRNSTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1033 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALYHPNKVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1034 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARRYQSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1035 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAAKAMKLGASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1036 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAAMGNASRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1037 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRALKITASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1038 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALSLNLVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1039 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALVANVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1040 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKFVPGTLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1041 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASIHPNAIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1042 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKMKVGVSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1043 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPVGAKKGASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1044 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASYEYTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1045 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAQEVSVDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1046 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVIMESEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1047 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAEGACIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1048 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVLFRNIPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1049 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKRSNATASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1050 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALRQNLVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1051 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALRINNVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1052 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRKAGTVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1053 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAQRLNNTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1054 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLADLTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1055 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPLADTVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1056 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGRCAIEVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1057 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQPDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1058 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKIRLDAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1059 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARRCILSAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1060 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAEVSSPDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1061 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVIMGSEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1062 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAVKYQSDLASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1063 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRQAKVAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1064 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAQMTNQVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1065 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGQSNQTRASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1066 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPVRAATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1067 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKTKSANSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1068 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAFSAHPNKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1069 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARIKGGVPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1070 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPWFRDNAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1071 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPSKGKSNASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1072 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTNNTVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1073 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKTSKSSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1074 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKYQAASASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1075 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPKANLAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1076 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGVIMGPEASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1077 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASYGIRLKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1078 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTGATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1079 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAARGVKVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1080 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGSIRSDMASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1081 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARIVILVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1082 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLRIPTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1083 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAAWGVKVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1084 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPTKKTAVASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1085 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAIMLNQVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1086 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPGLNYVKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1087 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKLHSGPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1088 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKWKSGASASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1089 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAWKAQKTSASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1090 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRTKGTAASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1091 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAPRHSKVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1092 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAGTANVTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1093 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALLGNMTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1094 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARKVHIEIASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1095 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAEVSCGPPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1096 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQAKAKAGVTASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1097 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALILNATKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1098 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQARSVNLTKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1099 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQASYEYGAKASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1100 - protein, 518 aa, Artificial Sequence
  Dependoparvovirus adeno associated virus 5 capsid protein comprising artificial peptide sequence
MGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNAPLTNTVKATGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQALKYRGPPASSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 1101 - protein, 11 aa, Artificial Sequence
  Artificial peptide sequence
  MISC_FEATURE (1)..(1): Xaa is Ala, Ser, Gly or may be absent
  misc_feature (2)..(6): Xaa can be any naturally occurring amino acid
  MISC_FEATURE (7)..(10): Xaa is any amino acid or may be absent
  MISC_FEATURE (11)..(11): Xaa is Ala, Ser, Gly or may be absent
XXXXXXXXXXX

SEQ ID NO: 1102 - protein, 9 aa, Artificial Sequence
  Artificial peptide sequence
  MISC_FEATURE (1)..(1): Xaa is Ala, Ser, Gly or may be absent
  misc_feature (2)..(8): Xaa can be any naturally occurring amino acid
  MISC_FEATURE (9)..(9): Xaa is Ala, Ser, Gly or may be absent
XXXXXXXXX

SEQ ID NO: 1103 - protein, 9 aa, Artificial Sequence
  Artificial peptide sequence
  MISC_FEATURE (2)..(2): Xaa is Pro, Arg, or Gly
  MISC_FEATURE (3)..(3): Xaa is Lys, Leu, or Arg
  MISC_FEATURE (4)..(4): Xaa is any amino acid
  MISC_FEATURE (5)..(5): Xaa is Asn, His, Lys, or Gln
  MISC_FEATURE (6)..(6): Xaa is any amino acid or Gly, Lys or Ser
  MISC_FEATURE (7)..(7): Xaa is any amino acid or Thr or Val
  MISC_FEATURE (8)..(8): Xaa is any amino acid or Lys or Val
AXXXXXXXA

SEQ ID NO: 1104 - protein, 9 aa, Artificial Sequence
  Artificial peptide sequence
  MISC_FEATURE (2)..(2): Xaa is Pro, Arg or Gly
  MISC_FEATURE (3)..(3): Xaa is Lys, Leu or Arg
  MISC_FEATURE (4)..(4): Xaa is any amino acid
  MISC_FEATURE (5)..(5): Xaa is Asn, His, Lys or Gln
  MISC_FEATURE (6)..(6): Xaa is any amino acid or Gly, Lys or Ser
  MISC_FEATURE (7)..(8): Xaa is any amino acid
AXXXXXXXA

SEQ ID NO: 1105 - protein, 9 aa, Artificial Sequence
  Artificial peptide sequence
  MISC_FEATURE (2)..(2): Xaa is Pro, Arg or Gly
  MISC_FEATURE (3)..(3): Xaa is Lys, Leu or Arg
  MISC_FEATURE (4)..(4): Xaa is any amino acid
  MISC_FEATURE (5)..(5): Xaa is Asn, His, Lys, or Gln
  MISC_FEATURE (6)..(6): Xaa is is any amino acid or Gly, Lys, or Ser
  MISC_FEATURE (7)..(7): Xaa is Thr or Val
  MISC_FEATURE (8)..(8): Xaa is any amino acid
AXXXXXXXA

SEQ ID NO: 1106 - protein, 9 aa, Artificial Sequence
  Artificial peptide sequence
  MISC_FEATURE (2)..(2): Xaa is Pro, Arg or Gly
  MISC_FEATURE (3)..(3): Xaa is Lys, Leu or Arg
  MISC_FEATURE (4)..(4): Xaa is any amino acid
  MISC_FEATURE (5)..(5): Xaa is Asn, His, Lys, or Gln
  MISC_FEATURE (6)..(6): Xaa is any amino acid or Gly, Lys or Ser
  MISC_FEATURE (7)..(7): Xaa is Thr or Val
  MISC_FEATURE (8)..(8): Xaa is Lys or Val
AXXXXXXXA

SEQ ID NO: 1107 - protein, 9 aa, Artificial Sequence
  Artificial peptide sequence
  MISC_FEATURE (2)..(2): Xaa is Pro, Arg or Gly
  MISC_FEATURE (3)..(3): Xaa is Lys, Leu or Arg
  MISC_FEATURE (4)..(4): Xaa is any amino acid
  MISC_FEATURE (5)..(5): Xaa is Asn, His, Lys, or Gln
  MISC_FEATURE (6)..(6): Xaa is Gly, Lys, or Ser
  MISC_FEATURE (7)..(7): Xaa is Thr or Val
  MISC_FEATURE (8)..(8): Xaa is Lys or Val
AXXXXXXXA

What is claimed is:

1. A recombinant adeno-associated virus (rAAV) virion, comprising:

a) an AAV5 capsid protein, wherein the capsid protein comprises two or more substitutions selected from S651A or S651V; T578A or T578V; and/or T582A or T582V in a parental AAV5 capsid; and b) a heterologous nucleic acid comprising a nucleotide sequence encoding a gene product.

2. The rAAV virion of claim 1, wherein the AAV5 capsid protein comprises T582A and S651A substitutions.

3. The rAAV virion of claim 1, wherein the AAV5 capsid protein comprises S651A, T578A, and T582A substitutions.

4. The rAAV virion of claim 1, wherein the AAV5 capsid protein comprises a sequence having at least 95% identity, at least 98% identity, or at least 99% identity to the sequence of SEQ ID NO: 73.

5. A pharmaceutical composition comprising the rAAV virion of claim 1.

6. An AAV5 capsid protein comprising two or more substitutions selected from S651A or S651V; T578A or T578V; and/or T582A or T582V in a parental AAV5 capsid.

7. The AAV5 capsid protein of claim 6, wherein the capsid protein comprises T582A and S651A substitutions.

8. The AAV5 capsid protein of claim 6, wherein the capsid protein comprises S651A, T578A, and T582A substitutions.

9. The AAV5 capsid protein of claim 6, wherein the capsid protein comprises a sequence having at least 90% identity, at least 95% identity, at least 98% identity, or at least 99% identity to the sequence of SEQ ID NO: 73.

10. A polynucleotide encoding the AAV5 capsid protein of claim 6.

* * * * *